United States Patent
Fukuyama et al.

(10) Patent No.: US 8,841,091 B2
(45) Date of Patent: Sep. 23, 2014

(54) ENZYMES FOR STARCH PROCESSING

(71) Applicants: Novozymes A/S, Bagsvaerd (DK); Novozymes North America, Inc., Franklinton, NC (US)

(72) Inventors: Shiro Fukuyama, Chiba (JP); Tomoko Matsui, Chiba (JP); Chee Leong Soong, Raleigh, NC (US); Eric Allain, Wake Forest, NC (US); Anders Vikso Nielsen, Slangerup (DK); Hiroaki Udagawa, Yokohama (JP); Ye Liu, Beijing (CN); Junxin Duan, Beijing (CN); Wenping Wu, Beijing (CN); Lene Nonboe Andersen, Alleroed (DK)

(73) Assignees: Novozymes Als, Boscvaerd (DK); Novozymec North America Inc., Franklinton, NC (US)

( * ) Notice: Subject to any disclaimer, the term of this patent is extended or adjusted under 35 U.S.C. 154(b) by 20 days.

(21) Appl. No.: 13/667,487

(22) Filed: Nov. 2, 2012

(65) Prior Publication Data

US 2014/0127753 A1 May 8, 2014

Related U.S. Application Data

(60) Division of application No. 12/973,113, filed on Dec. 20, 2010, now Pat. No. 8,512,986, which is a continuation of application No. 11/316,535, filed on Dec. 22, 2005, now abandoned.

(60) Provisional application No. 60/638,614, filed on Dec. 22, 2004, provisional application No. 60/650,612, filed on Feb. 7, 2005.

(51) Int. Cl.
| | | |
|---|---|---|
| C12P 19/00 | (2006.01) | |
| C12P 7/08 | (2006.01) | |
| C12P 19/04 | (2006.01) | |
| C12P 19/02 | (2006.01) | |
| C12N 9/26 | (2006.01) | |
| C12N 9/34 | (2006.01) | |
| C07H 21/04 | (2006.01) | |
| C07K 1/00 | (2006.01) | |
| C12P 19/14 | (2006.01) | |
| C12P 7/14 | (2006.01) | |
| C12N 9/96 | (2006.01) | |

(52) U.S. Cl.
CPC . *C12N 9/96* (2013.01); *C12P 19/14* (2013.01); *C12P 7/14* (2013.01)
USPC ............ 435/72; 435/163; 435/101; 435/105; 435/201; 435/205; 536/23.2; 536/23.4; 530/350

(58) Field of Classification Search
USPC ................ 435/72, 163, 101, 105, 201, 205; 536/23.2, 23.4; 530/350
See application file for complete search history.

(56) References Cited

U.S. PATENT DOCUMENTS

| | | | |
|---|---|---|---|
| 4,009,074 | A | 2/1977 | Walon |
| 4,591,560 | A | 5/1986 | Kainuma et al. |
| 4,727,026 | A | 2/1988 | Sawada et al. |
| 6,537,792 | B1 | 3/2003 | Allen et al. |
| 7,129,069 | B2 | 10/2006 | Borchert et al. |
| 7,189,552 | B2 | 3/2007 | Lan et al. |
| 2005/0054071 | A1 | 3/2005 | Udagawa et al. |
| 2005/0158839 | A1 | 7/2005 | Borchert et al. |
| 2006/0147581 | A1 | 7/2006 | Svendsen et al. |
| 2006/0257984 | A1 | 11/2006 | Borchert et al. |

FOREIGN PATENT DOCUMENTS

| | | |
|---|---|---|
| EP | 0 126 206 A2 | 11/1984 |
| EP | 0 171 218 A2 | 2/1986 |
| WO | WO 98/14601 A1 | 4/1998 |
| WO | WO 98/16633 A1 | 4/1998 |
| WO | WO 00/77165 A2 | 12/2000 |
| WO | WO 03/056002 A1 | 7/2003 |
| WO | WO 2004/055178 A1 | 7/2004 |
| WO | WO 2005/003311 A2 | 1/2005 |
| WO | WO 2006/065579 A2 | 6/2006 |
| WO | WO 2006/066579 A1 | 6/2006 |
| WO | WO 2006/066582 A1 | 6/2006 |

OTHER PUBLICATIONS

Broun et al., Science, vol. 282, pp. 1315-1317 (1998).
Chica et al., Current Opinion in Biotechnology, vol. 16, pp. 378-384 (2005).
Cornett et al., Protein Engineering, vol. 16, No. 7, pp. 521-529 (2003).
Devos et al., Proteins: Structure Function and Genetics, vol. 41, pp. 98-107 (2000).
Finnie et al., Journal of Applied Glycoscience, vol. 50, pp. 277-282, 2003.
Guo et al., PNAS, vol. 101, No. 25, pp. 9205-9210 (2004).
Kaneko et al., Journal of Fermentation and Bioengineering, vol. 81, No. 4, pp. 292-298 (1996).
Machovic et al., FEBS Journal, vol. 272, No. 21, pp. 5497-5513 (2005).
Nagasaka et al., Appl. Microbiol. Biotechnol., vol. 50, No. 3, pp. 323-330 (1998).
Nagasaka et al., Journal of Applied Glycoscience, vol. 46, No. 2, pp. 169-178 (1999).

(Continued)

*Primary Examiner* — Ganapathirama Raghu
(74) *Attorney, Agent, or Firm* — Michael W. Krenicky

(57) ABSTRACT

The present invention relates to polypeptides comprising a carbohydrate-binding module amino acid sequence and an alpha-amylase amino acid sequence as well as to the application of such polypeptides.

12 Claims, No Drawings

(56) References Cited

OTHER PUBLICATIONS

Ohdan et al., Applied and Environmental Microbiology, vol. 66, No. 7, pp. 3058-3064, 2000.
Paldi et al., Biochemistry Journal., vol. 372, pp. 905-910 (2003).
Seffernick et al., Journal of Bacteriology, vol. 183, No. 8, pp. 2405-2410 (2001).
Sen et al., Applied Biochemistry and Biotechnology, vol. 143, pp. 212-223 (2007).
Somkuti et al., Developments in Industrial Microbiology, vol. 21, pp. 327-337 (1979).
Whisstock et al., Quarterly Reviews of Biophysics, vol. 36, No. 3, pp. 307-340 (2003).
Witkowski et al., Biochemistry, vol. 38, pp. 11643-11650 (1999).

ENZYMES FOR STARCH PROCESSING

CROSS-REFERENCE TO RELATED APPLICATIONS

This application is a divisional of U.S. application Ser. No. 12/973,113 filed on Dec. 20, 2010, now U.S. Pat. No. 8,512,986, which is a continuation of U.S. application Ser. No. 11/316,535 filed on Dec. 22, 2005, now abandoned, which claims the benefit under 35 U.S.C. 119 of U.S. provisional application Nos. 60/638,614 and 60/650,612 filed Dec. 22, 2004 and Feb. 7, 2005, respectively, the contents of which are fully incorporated herein by reference.

CROSS-REFERENCE TO SEQUENCE LISTING

This application contains a Sequence Listing in computer readable form, which is incorporated herein by reference.

CROSS-REFERENCE TO DEPOSITED MICROORGANISMS

The present application refers to deposited microorganisms, which are fully incorporated herein by reference.

FIELD OF THE INVENTION

The present invention relates to polypeptides comprising a carbohydrate-binding module ("CBM") and an alpha-amylase catalytic domain. Furthermore, the invention relates to wild type alpha-amylases polypeptides comprising useful alpha-amylase catalytic domains and/or CBMs as well as to the catalytic domain sequences and/or CBM sequences. The invention also relates to the use of such polypeptides in a starch liquefaction process in which starch is degraded to smaller oligo- and/or polysaccharide fragments.

BACKGROUND OF THE INVENTION

A large number of enzymes and processes have been described for converting starch to starch hydrolysates, such as maltose, glucose or specialty syrups, either for use as sweeteners or as precursors for other saccharides such as fructose. Glucose may also be fermented to ethanol or other fermentation products, such as citric acid, monosodium glutamate, gluconic acid, sodium gluconate, calcium gluconate, potassium gluconate, glucono delta lactone, or sodium erythorbate, itaconic acid, lactic acid, gluconic acid; ketones; amino acids, glutamic acid (sodium monoglutaminate), penicillin, tetracyclin; enzymes; vitamins, such as riboflavin, B12, beta-carotene or hormones.

Starch is a high molecular-weight polymer consisting of chains of glucose units. It usually consists of about 80% amylopectin and 20% amylose. Amylopectin is a branched polysaccharide in which linear chains of alpha-1,4 D-glucose residues are joined by alpha-1,6 glucosidic linkages.

Amylose is a linear polysaccharide built up of D-glucopyranose units linked together by alpha-1,4 glucosidic linkages. In the case of converting starch into a soluble starch hydrolysate, the starch is depolymerized. The conventional depolymerization process consists of a gelatinization step and two consecutive process steps, namely a liquefaction process and a saccharification process.

Granular starch consists of microscopic granules, which are insoluble in water at room temperature. When an aqueous starch slurry is heated, the granules swell and eventually burst, dispersing the starch molecules into the solution. During this "gelatinization" process there is a dramatic increase in viscosity. As the solids level is 30-40% in a typical industrial process, the starch has to be thinned or "liquefied" so that it can be handled. This reduction in viscosity is today mostly obtained by enzymatic degradation. During the liquefaction step, the long-chained starch is degraded into smaller branched and linear units (maltodextrins) by an alpha-amylase. The liquefaction process is typically carried out at about 105-110° C. for about 5 to 10 minutes followed by about 1-2 hours at about 95° C. The temperature is then lowered to 60° C., a glucoamylase (also known as GA or AMG) or a beta-amylase and optionally a debranching enzyme, such as an isoamylase or a pullulanase are added, and the saccharification process proceeds for about 24 to 72 hours.

It will be apparent from the above discussion that the conventional starch conversion process is very energy consuming due to the different requirements in terms of temperature during the various steps. It is thus desirable to be able to select and/or design the enzymes used in the process so that the overall process can be performed without having to gelatinize the starch. Such "raw starch" processes are U.S. Pat. Nos. 4,591,560, 4,727,026, and 4,009,074, EP Patent No. 0171218 and Danish patent application PA 2003 00949. The present invention discloses polypeptides designed for, inter alia, such processes and comprising an amino acid sequence of a CBM and an amino acid sequence of a starch degrading enzyme. Hybrid enzymes are the subject of WO 98/14601, WO 00/77165, and PCT/US2004/020499

SUMMARY OF THE INVENTION

The present inventor have surprisingly discovered that by adding a carbohydrate-binding module (CBM) to certain alpha-amylases the activity and specificity can be altered thereby increasing the efficacy of various starch degrading processes, e.g., comprising degradation of raw, e.g., ungelatinized starch and/or gelatinized starch. Also by exchanging one CBM by another the activity and specificity can be altered.

Such hybrids consisting of a polypeptide having alpha-amylase activity and a carbohydrate binding module, primarily having affinity for starch, have the advantage over existing alpha-amylases that by selecting a catalytic domain with desire properties e.g. the pH profile, the temperature profile, the oxidation resistance, the calcium stability, the substrate affinity or the product profile can be combined with a carbohydrate binding module with stronger or weaker binding affinities, e.g., specific affinities for amylose, specific affinities for amylopectin or affinities for specific structure in the carbohydrate. Thus the invention relates to hybrids having altered properties relative to the alpha-amylase without the CBM and/or relative to prior art amylases, such as having increased stability and/or activity at low pH, e.g., at pH below 4, such as at 3.5, increased activity towards granular starch, and/or increased degradation of granular starch at low pH even in the absence of glucoamylase or at low glucoamylase levels, and/or with altered product profile.

Due to the superior hydrolysis activity of these polypeptide the overall starch conversion process can be performed without having to gelatinize the starch, i.e., the polypeptides hydrolyses granular starch in a raw starch process as well as fully or partially gelatinized starch in a traditional starch process.

Accordingly the invention provides in a first aspect a polypeptide comprising a first amino acid sequence comprising a catalytic module having alpha-amylase activity and a second amino acid sequence comprising a carbohydrate-binding module, wherein said second amino acid sequence has at least 60% homology to any amino acid sequence selected from the group consisting of SEQ ID NO: 52, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92, SEQ ID NO: 94, SEQ ID NO: 96, SEQ ID NO: 98, SEQ ID NO: 109, SEQ ID NO: 137, SEQ ID NO: 139, SEQ ID NO: 141 and SEQ ID NO: 143.

In a second aspect the invention provides a polypeptide having alpha-amylase activity, selected from the group consisting of: (a) a polypeptide having an amino acid sequence which has at least 75% homology with amino acids for the mature polypeptide selected from the group consisting of amino acids 1-441 in SEQ ID NO: 14, as amino acids 1-471 in SEQ ID NO: 18, as amino acids 1-450 in SEQ ID NO: 20, as amino acids 1-445 in SEQ ID NO: 22, as amino acids 1-498 in SEQ ID NO: 26, as amino acids 18-513 in SEQ ID NO: 28, as amino acids 1-507 in SEQ ID NO: 30, as amino acids 1-481 in SEQ ID NO: 32, as amino acids 1-495 in SEQ ID NO: 34, as amino acids 1-477 in SEQ ID NO: 38, as amino acids 1-449 in SEQ ID NO: 42, as amino acids 1-442 in SEQ ID NO: 115, as amino acids 1-441 in SEQ ID NO: 117, as amino acids 1-477 in SEQ ID NO: 125, as amino acids 1-446 in SEQ ID NO: 131, as amino acids 41-481 in SEQ ID NO: 157, as amino acids 22-626 in SEQ ID NO: 159, as amino acids 24-630 in SEQ ID NO: 161, as amino acids 27-602 in SEQ ID NO: 163, as amino acids 21-643 in SEQ ID NO: 165, as amino acids 29-566 in SEQ ID NO: 167, as amino acids 22-613 in SEQ ID NO: 169, as amino acids 21-463 in SEQ ID NO: 171, as amino acids 21-587 in SEQ ID NO: 173, as amino acids 30-773 in SEQ ID NO: 175, as amino acids 22-586 in SEQ ID NO: 177, as amino acids 20-582 in SEQ ID NO: 179, (b) a polypeptide which is encoded by a nucleotide sequence (i) which hybridizes under at least low stringency conditions with nucleotides 1-1326 in SEQ ID NO: 13, nucleotides 1-1413 in SEQ ID NO: 17, nucleotides 1-1350 in SEQ ID NO: 19, nucleotides 1-1338 in SEQ ID NO: 21, nucleotides 1-1494 in SEQ ID NO: 25, nucleotides 52-1539 in SEQ ID NO: 27, nucleotides 1-1521 in SEQ ID NO: 29, nucleotides 1-1443 in SEQ ID NO: 31, nucleotides 1-1485 in SEQ ID NO: 33, nucleotides 1-1431 in SEQ ID NO: 37, nucleotides 1-1347 in SEQ ID NO: 41, nucleotides 1-1326 in SEQ ID NO: 114, nucleotides 1-1323 in SEQ ID NO: 116, nucleotides 1-1431 in SEQ ID NO: 124, nucleotides 1-1338 in SEQ ID NO: 130, nucleotides 121-1443 in SEQ ID NO: 156, nucleotides 64-1878 in SEQ ID NO: 158, nucleotides 70-1890 in SEQ ID NO: 160, nucleotides 79-1806 in SEQ ID NO: 162, nucleotides 61-1929 in SEQ ID NO: 164, nucleotides 85-1701 in SEQ ID NO: 166, nucleotides 64-1842 in SEQ ID NO: 168, nucleotides 61-1389 in SEQ ID NO: 170, nucleotides 61-1764 in SEQ ID NO: 172, nucleotides 61-2322 in SEQ ID NO: 174, nucleotides 64-1761 in SEQ ID NO: 176, nucleotides 58-1749 in SEQ ID NO: 178, or (ii) which hybridizes under at least medium stringency conditions with the cDNA sequence contained in the polynucleotides shown as nucleotides 1-1326 in SEQ ID NO: 13, as nucleotides 1-1413 in SEQ ID NO: 17, as nucleotides 1-1350 in SEQ ID NO: 19, as nucleotides 1-1338 in SEQ ID NO: 21, as nucleotides 1-1494 in SEQ ID NO: 25, as nucleotides 52-1539 in SEQ ID NO: 27, as nucleotides 1-1521 in SEQ ID NO: 29, as nucleotides 1-1443 in SEQ ID NO: 31, as nucleotides 1-1485 in SEQ ID NO: 33, as nucleotides 1-1431 in SEQ ID NO: 37, as nucleotides 1-1347 in SEQ ID NO: 41, as nucleotides 1-1326 in SEQ ID NO: 114, as nucleotides 1-1323 in SEQ ID NO: 116, as nucleotides 1-1431 in SEQ ID NO: 124, as nucleotides 1-1338 in SEQ ID NO: 130, as nucleotides 121-1443 in SEQ ID NO: 156, as nucleotides 64-1878 in SEQ ID NO: 158, as nucleotides 70-1890 in SEQ ID NO: 160, as nucleotides 79-1806 in SEQ ID NO: 162, as nucleotides 61-1929 in SEQ ID NO: 164, as nucleotides 85-1701 in SEQ ID NO: 166, as nucleotides 64-1842 in SEQ ID NO: 168, as nucleotides 61-1389 in SEQ ID NO: 170, as nucleotides 61-1764 in SEQ ID NO: 172, as nucleotides 61-2322 in SEQ ID NO: 174, as nucleotides 64-1761 in SEQ ID NO: 176, as nucleotides 58-1749 in SEQ ID NO: 178, or (iii) a complementary strand of (i) or (ii); and (c) a variant comprising a conservative substitution, deletion, and/or insertion of one or more amino acids in an acid amino sequence selected from the group consisting of amino acids 1-441 in SEQ ID NO: 14, amino acids 1-471 in SEQ ID NO: 18, amino acids 1-450 in SEQ ID NO: 20, amino acids 1-445 in SEQ ID NO: 22, amino acids 1-498 in SEQ ID NO: 26, amino acids 18-513 in SEQ ID NO: 28, amino acids 1-507 in SEQ ID NO: 30, amino acids 1-481 in SEQ ID NO: 32, amino acids 1-495 in SEQ ID NO: 34, amino acids 1-477 in SEQ ID NO: 38, amino acids 1-449 in SEQ ID NO: 42, amino acids 1-442 in SEQ ID NO: 115, amino acids 1-441 in SEQ ID NO: 117, amino acids 1-477 in SEQ ID NO: 125, amino acids 1-446 in SEQ ID NO: 131, amino acids 41-481 in SEQ ID NO: 157, amino acids 22-626 in SEQ ID NO: 159, amino acids 24-630 in SEQ ID NO: 161, amino acids 27-602 in SEQ ID NO: 163, amino acids 21-643 in SEQ ID NO: 165, amino acids 29-566 in SEQ ID NO: 167, amino acids 22-613 in SEQ ID NO: 169, amino acids 21-463 in SEQ ID NO: 171, amino acids 21-587 in SEQ ID NO: 173, amino acids 30-773 in SEQ ID NO: 175, amino acids 22-586 in SEQ ID NO: 177 and amino acids 20-582 in SEQ ID NO: 179.

In a second aspect the invention provides a polypeptide having carbohydrate-binding affinity, selected from the group consisting of: (a) i) a polypeptide comprising an amino acid sequence which has at least 60% homology with a sequence selected from the group consisting of amino acids 529-626 of SEQ ID NO: 159, amino acids 533-630 of SEQ ID NO: 161, amino acids 508-602 of SEQ ID NO: 163, amino acids 540-643 of SEQ ID NO: 165, amino acids 502-566 of SEQ ID NO: 167, amino acids 513-613 of SEQ ID NO: 169, 492-587 of SEQ ID NO: 173, amino acids 30-287 of SEQ ID NO: 175, amino acids 487-586 of SEQ ID NO: 177 and amino acids 482-582 of SEQ ID NO: 179; (b) a polypeptide which is encoded by a nucleotide sequence which hybridizes under low stringency conditions with a polynucleotide probe selected from the group consisting of (i) the complementary strand of a sequence selected from the group consisting of nucleotides 1585-1878 in SEQ ID NO: 158, nucleotides 1597-1890 in SEQ ID NO: 160, nucleotides 1522-1806 in SEQ ID NO: 162, nucleotides 1618-1929 in SEQ ID NO: 164, nucleotides 1504-1701 in SEQ ID NO: 166, nucleotides 1537-1842 in SEQ ID NO: 168, nucleotides 1474-1764 in SEQ ID NO: 172, nucleotides 61-861 in SEQ ID NO: 174, nucleotides 1459-1761 in SEQ ID NO: 176 and nucleotides 1444-1749 in SEQ ID NO: 178, (c) a fragment of (a) or (b) that has carbohydrate binding affinity.

In other aspects the invention provides uses of the polypeptide of the first, second and/or third aspect for saccharification, in a process comprising fermentation, in a starch conversion process, in a process for producing oligosaccharides, e.g., a process for producing maltodextrins or glucose and/or fructose syrups, in a process for producing fuel or drinking ethanol, for producing a beverage, and/or in a fermentation process for producing organic compounds, such as citric acid, ascorbic acid, lysine, glutamic acid.

In a further aspect the invention provides a composition comprising the polypeptide of the first, second and/or third aspect.

In a further aspect the invention provides a process for saccharifying starch, wherein a starch is treated with the polypeptide of the first, second and/or third aspect.

In a further aspect the invention provides a process comprising; a) contacting a starch with a polypeptide comprising a catalytic module having alpha-amylase activity and a carbohydrate-binding module, e.g., the polypeptide of the first, second and/or third aspect; b) incubating said starch with said polypeptide; c) fermenting to produce a fermentation product, d) optionally recovering the fermentation product, wherein an enzyme having glucoamylase activity is either absent or present in an amount of less than 0.5 AGU/g DS of starch substrate and wherein step a, b, c, and/or d may be performed separately or simultaneously.

In a further aspect the invention provides a process comprising; a) contacting a starch substrate with a yeast cell transformed to express a polypeptide comprising a catalytic module having alpha-amylase activity and a carbohydrate-binding module, e.g., the polypeptide of the first and/or second aspect; b) holding said starch substrate with said yeast; c) fermenting to produce ethanol; d) optionally recovering ethanol, wherein steps a), b), and c) are performed separately or simultaneously. In a preferred embodiment comprise holding the substrate with said yeast for a time and at a temperature sufficient to achieve conversion of at least 90% w/w of said starch substrate into fermentable sugars.

In a further aspect the invention provides a process of producing ethanol from starch-containing material by fermentation, said process comprises: (i) liquefying said starch-containing material with a polypeptide comprising a catalytic module having alpha-amylase activity and a carbohydrate-binding module, e.g., the polypeptide of the first and/or second aspect; (ii) saccharifying the liquefied mash obtained; (iii) fermenting the material obtained in step (ii) in the presence of a fermenting organism and optionally comprising recovery of the ethanol.

In further aspects the invention provides a DNA sequence encoding a polypeptide according to the first, second and/or third aspect, a DNA construct comprising said DNA sequence, a recombinant expression vector which carries said DNA construct, a host cell which is transformed with said DNA construct or said vector, said host cell, which is a microorganism, in particular a bacterium or a fungal cell, a yeast or a plant cell.

DETAILED DESCRIPTION OF THE INVENTION

The term "granular starch" is understood as raw uncooked starch, i.e., starch that has not been subjected to a gelatinization. Starch is formed in plants as tiny granules insoluble in water. These granules are preserved in starches at temperatures below the initial gelatinization temperature. When put in cold water, the grains may absorb a small amount of the liquid. Up to 50° C. to 70° C. the swelling is reversible, the degree of reversibility being dependent upon the particular starch. With higher temperatures an irreversible swelling called gelatinization begins.

The term "initial gelatinization temperature" is understood as the lowest temperature at which gelatinization of the starch commences. Starch heated in water begins to gelatinize between 50° C. and 75° C.; the exact temperature of gelatinization depends on the specific starch and can readily be determined by the skilled artisan. Thus, the initial gelatinization temperature may vary according to the plant species, to the particular variety of the plant species as well as with the growth conditions. In the context of this invention the initial gelatinization temperature of a given starch is the temperature at which birefringence is lost in 5% of the starch granules using the method described by Gorinstein and Lii, 1992, *Starch/Stärke* 44(12): 461-466.

The term "soluble starch hydrolysate" is understood as the soluble products of the processes of the invention and may comprise mono-, di-, and oligosaccharides, such as glucose, maltose, maltodextrins, cyclodextrins and any mixture of these. Preferably at least 90%, at least 91%, at least 92%, at least 93%, at least 94%, at least 95%, at least 96%, at least 97% or at least 98% of the dry solids of the granular starch is converted into a soluble starch hydrolysate.

The term polypeptide "homology" is understood as the degree of identity between two sequences indicating a derivation of the first sequence from the second. The homology may suitably be determined by means of computer programs known in the art such as GAP provided in the GCG program package (Program Manual for the Wisconsin Package, Version 8, August 1994, Genetics Computer Group, 575 Science Drive, Madison, Wis., USA 53711) (Needleman and Wunsch, 1970, *Journal of Molecular Biology* 48: 443-453. The following settings for amino acid sequence comparison are used: GAP creation penalty of 3.0 and GAP extension penalty of 0.1. The relevant part of the amino acid sequence for the homology determination is the mature polypeptide, i.e., without the signal peptide.

Suitable experimental conditions for determining hybridization at low, medium, or high stringency between a nucleotide probe and a homologous DNA or RNA sequence involves presoaking of the filter containing the DNA fragments or RNA to hybridize in 5×SSC (Sodium chloride/Sodium citrate, Sambrook et al., 1989) for 10 min, and pre-hybridization of the filter in a solution of 5×SSC, 5×Denhardt's solution (Sambrook et al., 1989), 0.5% SDS and 100 micrograms/ml of denatured sonicated salmon sperm DNA (Sambrook et al., 1989), followed by hybridization in the same solution containing a concentration of 10 ng/ml of a random-primed (Feinberg and Vogelstein, 1983, *Anal. Biochem.* 132: 6-13), 32P-dCTP-labeled (specific activity >1×10^9 cpm/microgram) probe for 12 hours at about 45° C. The filter is then washed twice for 30 minutes in 2×SSC, 0.5% SDS at about 55° C. (low stringency), more preferably at about 60° C. (medium stringency), still more preferably at about 65° C. (medium/high stringency), even more preferably at about 70° C. (high stringency), and even more preferably at about 75° C. (very high stringency).

Molecules to which the oligonucleotide probe hybridizes under these conditions are detected using an x-ray film.

Polypeptides

The polypeptide of the invention may be a hybrid enzyme or the polypeptide may be a wild type enzyme which already comprises a catalytic module having alpha-amylase activity and a carbohydrate-binding module. The polypeptide of the invention may also be a variant of such a wild type enzyme. The hybrid may be produced by fusion of a first DNA sequence encoding a first amino acid sequences and a second DNA sequence encoding a second amino acid sequences, or the hybrid may be produced as a completely synthetic gene based on knowledge of the amino acid sequences of suitable CBMs, linkers and catalytic domains.

The terms "hybrid enzyme" or "hybrid polypeptide" is used herein to characterize those of the polypeptides of the invention that comprises a first amino acid sequence comprising at least one catalytic module having alpha-amylase activity and a second amino acid sequence comprising at least one carbohydrate-binding module wherein the first and the second are derived from different sources. The term "source" being understood as, e.g., but not limited to a parent enzyme, e.g., an amylase or glucoamylase, or other catalytic activity comprising a suitable catalytic module and/or a suitable CBM and/or a suitable linker.

The Enzyme classification numbers (EC numbers) are in accordance with the Recommendations of the Nomenclature Committee of the International Union of Biochemistry and Molecular Biology, Academic Press Inc, 1992.

Polypeptides as referred to herein include species comprising an amino acid sequence of an alpha-amylase enzyme (EC 3.2.1.1) linked (i.e., covalently bound) to an amino acid sequence comprising a carbohydrate-binding module (CBM).

CBM-containing hybrid enzymes, as well as detailed descriptions of the preparation and purification thereof, are known in the art [see, e.g., WO 90/00609, WO 94/24158 and WO 95/16782, as well as Greenwood et al., 1994, *Biotechnology and Bioengineering* 44: 1295-1305]. They may, e.g., be prepared by transforming into a host cell a DNA construct comprising at least a fragment of DNA encoding the carbohydrate-binding module ligated, with or without a linker, to a DNA sequence encoding the polypeptide of interest, and growing the transformed host cell to express the fused gene. The CBM in a polypeptide of the invention may be positioned C-terminally, N-terminally or internally in polypeptide. In an embodiment a polypeptide may comprise more than one CBM, e.g., two CBMs; one positioned C-terminally, the other N-terminally or the two CBMs in tandem positioned C-terminally, N-terminally or internally. However, polypeptides with more than two CBMs are equally contemplated.

Alpha-Amylases of the Invention

The invention relates to alpha-amylase polypeptides useful as donors (parent amylases) of CBMs, linkers and/or catalytic modules. The polypeptide of the invention may be a wild type alpha-amylase enzyme (EC 3.2.1.1) or the polypeptide may also be a variant of such a wild type enzyme. Furthermore the polypeptide of the invention may be a fragment of such an enzyme, e.g., such as a catalytic domain, i.e., a fragment having alpha-amylase activity but which is separated from a CBM if such is present in the wild-type enzyme, or such as a CBM, i.e., a fragment having a carbohydrate binding module. It may also be a hybrid enzyme comprising a fragment of such an alpha-amylase enzyme, e.g., comprising a catalytic domain, a linker and/or a CBM derived from an alpha-amylase enzyme of the invention.

Furthermore, the polypeptide of the invention may be a fragment of such an enzyme, e.g., a fragment which still comprises a functional catalytic domain as well as a CBM if such is present in the wild type enzyme, or, e.g., a fragment of a wild-type enzyme, which wild-type enzyme does not comprise a CBM, and wherein said fragment comprises a functional catalytic domain.

Alpha-Amylase Enzymes:

The invention relates to novel polypeptides comprising a carbohydrate-binding module ("CBM") and having alpha-amylase activity. Such polypeptides may be derived from any organism, preferred are those of fungal or bacterial origin.

The alpha-amylases of the invention include alpha-amylases obtainable from a species within a genus selected from the list consisting of *Absidia, Acremonium, Coniochaeta, Coriolus, Cryptosporiopsis, Dichotomocladium, Dinemasporium, Diplodia, Fusarium, Gliocladium, Malbranchea, Meripilus, Necteria, Penicillium, Rhizomucor, Stereum, Streptomyces, Subulispora, Syncephalastrum, Thamindium, Thermoascus, Thermomyces, Trametes, Trichophaea* and *Valsaria*. The alpha-amylase may be derived from any genus, species or sequence listed in table 1.

Preferably the alpha-amylase is derived from any species selected from the group consisting of *Thermomyces lanuginosus*; in particular a polypeptide having the amino acids 1-441 in SEQ ID NO: 14, *Malbranchea* sp.; in particular a polypeptide having the amino acids 1-471 in SEQ ID NO: 18, *Rhizomucor pusillus*; in particular a polypeptide having the amino acids 1-450 in SEQ ID NO: 20, *Dichotomocladium hesseltinei*; in particular a polypeptide having the amino acids 1-445 in SEQ ID NO: 22, *Stereum* sp.; in particular a polypeptide having the amino acids 1-498 in SEQ ID NO: 26, *Trametes* sp.; in particular a polypeptide having the amino acids 18-513 in SEQ ID NO: 28, *Coriolus consors*; in particular a polypeptide having the amino acids 1-507 in SEQ ID NO: 30, *Dinemasporium* sp.; in particular a polypeptide having the amino acids 1-481 in SEQ ID NO: 32, *Cryptosporiopsis* sp.; in particular a polypeptide having the amino acids 1-495 in SEQ ID NO: 34, *Diplodia* sp.; in particular a polypeptide having the amino acids 1-477 in SEQ ID NO: 38, *Gliocladium* sp.; in particular a polypeptide having the amino acids 1-449 in SEQ ID NO: 42, *Nectria* sp.; in particular a polypeptide having the amino acids 1-442 in SEQ ID NO: 115, *Fusarium* sp.; in particular a polypeptide having the amino acids 1-441 in SEQ ID NO: 117, *Thermoascus auranticus*; in particular a polypeptide having the amino acids 1-477 in SEQ ID NO: 125, *Thamindium elegans*; in particular a polypeptide having the amino acids 1-446 in SEQ ID NO: 131, *Absidia cristata*; in particular a polypeptide having the amino acids 41-481 in SEQ ID NO: 157, *Acremonium* sp.; in particular a polypeptide having the amino acids 22-626 in SEQ ID NO: 159, *Coniochaeta* sp.; in particular a polypeptide having the amino acids 24-630 in SEQ ID NO: 161, *Meripilus giganteus*; in particular a polypeptide having the amino acids 27-602 in SEQ ID NO: 163, *Penicillium* sp.; in particular a polypeptide having the amino acids 21-643 in SEQ ID NO: 165, *Streptomyces limosus*; in particular a polypeptide having the amino acids 29-566 in SEQ ID NO: 167, *Subulispora procurvata*; in particular a polypeptide having the amino acids 22-613 in SEQ ID NO: 169, *Syncephalastrum racemosum*; in particular a polypeptide having the amino acids 21-463 in SEQ ID NO: 171, *Trametes currugata*; in particular a polypeptide having the amino acids 21-587 in SEQ ID NO: 173, *Trichophaea saccata*; in particular a polypeptide having the amino acids 30-773 in SEQ ID NO: 175, *Valsaria rubricosa*; in particular a polypeptide having the amino acids 22-586 in SEQ ID NO: 177 and *Valsaria spartii*; in particular a polypeptide having the amino acids 20-582 in SEQ ID NO: 179.

Also preferred are alpha-amylase amino acid sequences having at least 60%, at least 65%, at least 70%, at least 75%, at least 80%, at least 85%, at least 90%, at least 95%, or even at least 98% homology to the mature peptide of any of the aforementioned polypeptides. In another preferred embodiment the alpha-amylase amino acid sequence have an amino acid sequence which differs from any of the aforementioned amino acid sequences in no more than 10 positions, no more than 9 positions, no more than 8 positions, no more than 7 positions, no more than 6 positions, no more than 5 positions, no more than 4 positions, no more than 3 positions, no more than 2 positions, or even no more than 1 position.

Also preferred are alpha-amylase amino acid sequence encoded by a DNA sequence having at least 50%, at least 60%, at least 65%, at least 70%, at least 75%, at least 80%, at least 85%, at least 90%, at least 95%, or even at least 98% homology to any sequence selected from the group consisting of the polynucleotides shown as SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 154 and SEQ ID NO: 156. SEQ ID NO: 13, SEQ ID NO: 17, SEQ ID NO: 19, SEQ ID NO: 21, SEQ ID NO: 25, SEQ ID NO: 27, SEQ ID NO: 29, SEQ ID NO: 31, SEQ ID NO: 33, SEQ ID NO: 37, SEQ ID NO: 41, SEQ ID NO: 114, SEQ ID NO: 116, SEQ ID NO: 124, SEQ ID NO: 130, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176 and SEQ ID NO: 178. Further preferred is any alpha-amylase amino acid sequence encoded by a DNA sequence which hybridizes under low, medium, medium/high, high and/or very high stringency to any of the aforementioned alpha-amylase DNA sequences. Also preferred are DNA sequences encoding an alpha-amylase amino acid sequence and having at least 50%, at least 60%, at least 65%, at least 70%, at least 75%, at least 80%, at least 85%, at least 90%, at least 95%, at least 99%, or even 100% homology any of the aforementioned alpha-amylase DNA sequences.

Alpha-Amylase Catalytic Domains:

In one embodiment the invention relates to catalytic domains derived from polypeptides comprising a carbohydrate-binding module ("CBM") and an having alpha-amylase activity, such as catalytic domains derived from a polypeptide selected from the alpha-amylases shown in SEQ ID NO: 14, SEQ ID NO: 18, SEQ ID NO: 20, SEQ ID NO: 22, SEQ ID NO: 26, SEQ ID NO: 28, SEQ ID NO: 30, SEQ ID NO: 32, SEQ ID NO: 34, SEQ ID NO: 38, SEQ ID NO: 42, SEQ ID NO: 115, SEQ ID NO: 117, SEQ ID NO: 125, SEQ ID NO: 131, SEQ ID NO: 157, SEQ ID NO: 159, SEQ ID NO: 161, SEQ ID NO: 163, SEQ ID NO: 165, SEQ ID NO: 167, SEQ ID NO: 169, SEQ ID NO: 171, SEQ ID NO: 173, SEQ ID NO: 175, SEQ ID NO: 177 and SEQ ID NO: 179. Preferred are the catalytic domains shown in the amino acids 1-441 in SEQ ID NO: 14, the amino acids 1-471 in SEQ ID NO: 18, the amino acids 1-450 in SEQ ID NO: 20, the amino acids 1-445 in SEQ ID NO: 22, the amino acids 1-498 in SEQ ID NO: 26, the amino acids 18-513 in SEQ ID NO: 28, the amino acids 1-507 in SEQ ID NO: 30, the amino acids 1-481 in SEQ ID NO: 32, the amino acids 1-495 in SEQ ID NO: 34, the amino acids 1-477 in SEQ ID NO: 38, the amino acids 1-449 in SEQ ID NO: 42, the amino acids 1-442 in SEQ ID NO: 115, the amino acids 1-441 in SEQ ID NO: 117, the amino acids 1-477 in SEQ ID NO: 125, the amino acids 1-446 in SEQ ID NO: 131, the amino acids 41-481 in SEQ ID NO: 157, the amino acids 22-502 in SEQ ID NO: 159, the amino acids 24-499 in SEQ ID NO: 161, the amino acids 27-492 in SEQ ID NO: 163, the amino acids 21-496 in SEQ ID NO: 165, the amino acids 29-501 in SEQ ID NO: 167, the amino acids 22-487 in SEQ ID NO: 169, the amino acids 21-463 in SEQ ID NO: 171, the amino acids 21-477 in SEQ ID NO: 173, the amino acids 288-773 in SEQ ID NO: 175, the amino acids 22-471 in SEQ ID NO: 177 and the amino acids 20-470 in SEQ ID NO: 179. Also preferred are catalytic domain sequences having at least 60%, at least 65%, at least 70%, at least 75%, at least 80%, at least 85%, at least 90% or even at least 95% homology to any of the aforementioned catalytic domain sequences. In another preferred embodiment the catalytic domain sequence have an amino acid sequence which differs from any of the aforementioned catalytic domain sequences in no more than 10 positions, no more than 9 positions, no more than 8 positions, no more than 7 positions, no more than 6 positions, no more than 5 positions, no more than 4 positions, no more than 3 positions, no more than 2 positions, or even no more than 1 position.

Also preferred are catalytic domain amino acid sequence encoded by a DNA sequence having at least 50%, at least 60%, at least 65%, at least 70%, at least 75%, at least 80%, at least 85%, at least 90% or even at least 95% homology to any sequence selected from the group consisting of the polynucleotides shown as the nucleotides 1-1326 in SEQ ID NO: 13, nucleotides 1-1413 in SEQ ID NO: 17, nucleotides 1-1350 in SEQ ID NO: 19, nucleotides 1-1338 in SEQ ID NO: 21, nucleotides 1-1494 in SEQ ID NO: 25, nucleotides 52-1539 in SEQ ID NO: 27, nucleotides 1-1521 in SEQ ID NO: 29, nucleotides 1-1443 in SEQ ID NO: 31, nucleotides 1-1485 in SEQ ID NO: 33, nucleotides 1-1431 in SEQ ID NO: 37, nucleotides 1-1347 in SEQ ID NO: 41, nucleotides 1-1326 in SEQ ID NO: 114, nucleotides 1-1323 in SEQ ID NO: 116, nucleotides 1-1431 in SEQ ID NO: 124, nucleotides 1-1338 in SEQ ID NO: 130, nucleotides 121-1443 in SEQ ID NO: 156, nucleotides 64-1506 in SEQ ID NO: 158, nucleotides 70-1497 in SEQ ID NO: 160, nucleotides 79-1476 in SEQ ID NO: 162, nucleotides 61-1488 in SEQ ID NO: 164, nucleotides 85-1503 in SEQ ID NO: 166, nucleotides 64-1461 in SEQ ID NO: 168, nucleotides 61-1389 in SEQ ID NO: 170, nucleotides 61-1431 in SEQ ID NO: 172, nucleotides 862-2322 in SEQ ID NO: 174, nucleotides 64-1413 in SEQ ID NO: 176 and nucleotides 58-1410 in SEQ ID NO: 178. Further preferred is any catalytic domain amino acid sequence encoded by a DNA sequence hybridizing under low, medium, medium/high, high and/or very high stringency to any of the aforementioned DNA sequences. Also preferred are DNA sequences encoding a catalytic domain amino acid sequence and having at least 50%, at least 60%, at least 65%, at least 70%, at least 75%, at least 80%, at least 85%, at least 90%, at least 95%, at least 99%, or even 100% homology any of the aforementioned catalytic domain DNA sequences.

Linker Sequences:

In one embodiment the invention relates to linker sequences derived from polypeptides comprising a carbohydrate-binding module ("CBM") and an having alpha-amylase activity. Preferred are a linker amino acid sequences selected from the group consisting of the shown as amino acids 503-528 in SEQ ID NO: 159, amino acids 500-532 in SEQ ID NO: 161, amino acids 493-507 in SEQ ID NO: 163, amino acids 497-539 in SEQ ID NO: 165, amino acids 488-512 in SEQ ID NO: 169 in 478-491 in SEQ ID NO: 173, amino acids 472-486 in SEQ ID NO: 177 and amino acids 471-481 in SEQ ID NO: 179. Also preferred are linker amino acid sequences having at least 60%, at least 65%, at least 70%, at least 75%, at least 80%, at least 85%, at least 90% or even at least 95% homology to any of the aforementioned linker sequences. In another preferred embodiment the linker sequence have an amino acid sequence which differs from any of the aforementioned linker sequences in no more than 10 positions, no more than 9 positions, no more than 8 positions, no more than 7 positions, no more than 6 positions, no more than 5 positions, no more than 4 positions, no more than 3 positions, no more than 2 positions, or even no more than 1 position.

Carbohydrate-Binding Modules:

In one embodiment the invention relates to CBMs derived from polypeptides comprising a carbohydrate-binding module ("CBM") and an having alpha-amylase activity, said CBM derived from a polypeptide selected from the alpha-amylases shown in SEQ ID NO: 14, SEQ ID NO: 18, SEQ ID NO: 20, SEQ ID NO: 22, SEQ ID NO: 26, SEQ ID NO: 28, SEQ ID NO: 30, SEQ ID NO: 32, SEQ ID NO: 34, SEQ ID NO: 38, SEQ ID NO: 42, SEQ ID NO: 115, SEQ ID NO: 117, SEQ ID NO: 125, SEQ ID NO: 131, SEQ ID NO: 157, SEQ ID NO: 159, SEQ ID NO: 161, SEQ ID NO: 163, SEQ ID NO: 165, SEQ ID NO: 167, SEQ ID NO: 169, SEQ ID NO: 171, SEQ ID NO: 173, SEQ ID NO: 175, SEQ ID NO: 177 and SEQ ID NO: 179. Preferred are a CBM amino acid sequence selected from the group consisting of the sequence having the amino acids 529-626 in SEQ ID NO: 159, the amino acids 533-630 in SEQ ID NO: 161, the amino acids 508-602 in SEQ ID NO: 163, the amino acids 540-643 in SEQ ID NO: 165, the amino acids 502-566 in SEQ ID NO: 167, the amino acids 513-613 in SEQ ID NO: 169, the amino acids 492-587 in SEQ ID NO: 173, the amino acids 30-287 in SEQ ID NO: 175, the amino acids 487-586 in SEQ ID NO: 177 and the amino acids 482-582 in SEQ ID NO: 179. Also preferred are CBM amino acid sequences having at least 60%, at least 65%, at least 70%, at least 75%, at least 80%, at least 85%, at least 90% or even at least 95% homology to any of the aforementioned CBM amino acid sequences. In another preferred embodiment the CBM sequence have an amino acid sequence which differs from any of the aforementioned CBM sequences in no more than 10 positions, no more than 9 positions, no more than 8 positions, no more than 7 positions, no more than 6 positions, no more than 5 positions, no more than 4 positions, no more than 3 positions, no more than 2 positions, or even no more than 1 position.

Also preferred are a CBM amino acid sequence encoded by a DNA sequence having at least 50%, at least 60%, at least 65%, at least 70%, at least 75%, at least 80%, at least 85%, at least 90% or even at least 95% homology to any sequence selected from the group consisting of the polynucleotides shown as nucleotides 1585-1878 in SEQ ID NO: 158, nucleotides 1597-1890 in SEQ ID NO: 160, nucleotides 1522-1806 in SEQ ID NO: 162, nucleotides 1618-1929 in SEQ ID NO: 164, nucleotides 1504-1701 in SEQ ID NO: 166, nucleotides 1537-1842 in SEQ ID NO: 168, nucleotides 1474-1764 in SEQ ID NO: 172, nucleotides 61-861 in SEQ ID NO: 174, nucleotides 1459-1761 in SEQ ID NO: 176 and nucleotides 1444-1749 in SEQ ID NO: 178. SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 154 and SEQ ID NO: 156. Further preferred is any CBM amino acid sequence encoded by a DNA sequence hybridizing under low, medium, medium/high, high and/or very high stringency to the complementary DNA sequence of any of the aforementioned CBM DNA sequences. Also preferred are DNA sequences encoding a CBM amino acid sequence and having at least 50%, at least 60%, at least 65%, at least 70%, at least 75%, at least 80%, at least 85%, at least 90%, at least 95%, at least 99%, or even 100% homology any of the aforementioned CBM DNA sequences.

The DNA sequences shown as nucleotides 1504-1701 in SEQ ID NO: 166 and nucleotides 61-861 in SEQ ID NO: 174 and the encoded amino acid sequences comprise in addition to the CBD also a linker sequence.

TABLE 1

Alpha-amylases used as catalytic doman and CBM donors. Positions for catalytic domain, linker and CBM sequences.

| Species | Strain No | SEQ ID NO | Mature peptide | Catalytic domain | Linker | CBM | Type |
|---|---|---|---|---|---|---|---|
| Absidia cristata | NN047841 | SEQ ID NO: 156 | 121-1443 | 121-1443 | | | Dna |
| Absidia cristata | NN047841 | SEQ ID NO: 157 | 41-481 | 41-481 | | | Aa |
| Acremonium sp. | NN045509 | SEQ ID NO: 158 | 64-1878 | 64-1506 | 1507-1584 | 1585-1878 | Dna |
| Acremonium sp. | NN045509 | SEQ ID NO: 159 | 22-626 | 22-502 | 503-528 | 529-626 | Aa |
| Coniochaeta sp. | NN047603 | SEQ ID NO: 160 | 70-1890 | 70-1497 | 1498-1596 | 1597-1890 | Dna |
| Coniochaeta sp. | NN047603 | SEQ ID NO: 161 | 24-630 | 24-499 | 500-532 | 533-630 | Aa |
| Coriolus consors | NN048884 | SEQ ID NO: 29 | 1-1521 | 1-1521 | | | Dna |
| Coriolus consors | NN048884 | SEQ ID NO: 30 | 1-507 | 1-507 | | | Aa |
| Cryptosporiopsis sp. | NN047117 | SEQ ID NO: 33 | 1-1485 | 1-1485 | | | Dna |
| Cryptosporiopsis sp. | NN047117 | SEQ ID NO: 34 | 1-495 | 1-495 | | | Aa |
| Dichotomocladium hesseltinei | NN103100 | SEQ ID NO: 21 | 1-1338 | 1-1338 | | | Dna |
| Dichotomocladium hesseltinei | NN103100 | SEQ ID NO: 22 | 1-445 | 1-445 | | | Aa |
| Dinemasporium sp. | NN043050 | SEQ ID NO: 31 | 1-1443 | 1-1443 | | | Dna |
| Dinemasporium sp. | NN043050 | SEQ ID NO: 32 | 1-481 | 1-481 | | | Aa |
| Diplodia sp. | NN047649 | SEQ ID NO: 37 | 1-1431 | 1-1431 | | | Dna |
| Diplodia sp. | NN047649 | SEQ ID NO: 38 | 1-477 | 1-477 | | | Aa |
| Fusarium sp. | NN046318 | SEQ ID NO: 116 | 1-1323 | 1-1323 | | | Dna |
| Fusarium sp. | NN046318 | SEQ ID NO: 117 | 1-441 | 1-441 | | | Aa |
| Gliocladium sp. | NN047683 | SEQ ID NO: 41 | 1-1347 | 1-1347 | | | Dna |
| Gliocladium sp. | NN047683 | SEQ ID NO: 42 | 1-449 | 1-449 | | | Aa |
| Malbranchea sp. | NN046840 | SEQ ID NO: 17 | 1-1413 | 1-1413 | | | Dna |
| Malbranchea sp. | NN046840 | SEQ ID NO: 18 | 1-471 | 1-471 | | | Aa |
| Meripilus giganteus | NN006040 | SEQ ID NO: 162 | 79-1806 | 79-1476 | 1477-1521 | 1522-1806 | Dna |
| Meripilus giganteus | NN006040 | SEQ ID NO: 163 | 27-602 | 27-492 | 493-507 | 508-602 | Aa |
| Nectria sp. | NN047728 | SEQ ID NO: 114 | 1-1326 | 1-1326 | | | Dna |
| Nectria sp. | NN047728 | SEQ ID NO: 115 | 1-442 | 1-442 | | | Aa |
| Penicillium sp. | NN050730 | SEQ ID NO: 164 | 61-1929 | 61-1488 | 1489-1617 | 1618-1929 | Dna |
| Penicillium sp. | NN050730 | SEQ ID NO: 165 | 21-643 | 21-496 | 497-539 | 540-643 | Aa |
| Rhizomucor pusillus | NN101459 | SEQ ID NO: 19 | 1-1350 | 1-1350 | | | Dna |
| Rhizomucor pusillus | NN101459 | SEQ ID NO: 20 | 1-450 | 1-450 | | | Aa |
| Stereum sp. | NN048875 | SEQ ID NO: 25 | 1-1494 | 1-1494 | | | Dna |
| Stereum sp. | NN048875 | SEQ ID NO: 26 | 1-498 | 1-498 | | | Aa |
| Streptomyces limosus | ATCC19778 | SEQ ID NO: 166 | 85-1701 | 85-1503 | | [1]1504-1701 | Dna |

TABLE 1-continued

Alpha-amylases used as catalytic doman and CBM donors. Positions for catalytic domain, linker and CBM sequences.

| Species | Strain No | SEQ ID NO | Mature peptide | Catalytic domain | Linker | CBM | Type |
|---|---|---|---|---|---|---|---|
| Streptomyces limosus | ATCC19778 | SEQ ID NO: 167 | 29-566 | 29-501 | | [1)]502-566 | Aa |
| Subulispora procurvata | NN042875 | SEQ ID NO: 169 | 22-613 | 22-487 | 488-512 | 513-613 | Aa |
| Subulispora provurvata | NN042875 | SEQ ID NO: 168 | 64-1842 | 64-1461 | 1462-1536 | 1537-1842 | Dna |
| Syncephalastrum racemosum | NN047920 | SEQ ID NO: 170 | 61-1389 | 61-1389 | | | Dna |
| Syncephalastrum racemosum | NN047920 | SEQ ID NO: 171 | 21-463 | 21-463 | | | Aa |
| Thamindium elegans | NN050372 | SEQ ID NO: 130 | 1-1338 | 1-1338 | | | Dna |
| Thamindium elegans | NN050372 | SEQ ID NO: 131 | 1-446 | 1-446 | | | Aa |
| Thermoascus auranticus | NN047354 | SEQ ID NO: 124 | 1-1431 | 1-1431 | | | Dna |
| Thermoascus auranticus | NN047354 | SEQ ID NO: 125 | 1-477 | 1-477 | | | Aa |
| Thermomyces lanuginosus | NN044958 | SEQ ID NO: 13 | 1-1326 | 1-1326 | | | Dna |
| Thermomyces lanuginosus | NN044958 | SEQ ID NO: 14 | 1-441 | 1-441 | | | Aa |
| Trametes currugata | CGMCC5.61 | SEQ ID NO: 172 | 61-1764 | 61-1431 | 1432-1473 | 1474-1764 | Dna |
| Trametes currugata | CGMCC5.61 | SEQ ID NO: 173 | 21-587 | 21-477 | 478-491 | 492-587 | Aa |
| Trametes sp. | NN048968 | SEQ ID NO: 27 | 52-1539 | 52-1539 | | | Dna |
| Trametes sp. | NN048968 | SEQ ID NO: 28 | 18-513 | 18-513 | | | aa |
| Trichophaea saccata | NN102806 | SEQ ID NO: 174 | 61-2322 | 862-2322 | | [1)]61-861 | Dna |
| Trichophaea saccata | NN102806 | SEQ ID NO: 175 | 30-773 | 288-773 | | [1)]30-287 | Aa |
| Valsaria rubricosa | NN046835 | SEQ ID NO: 176 | 64-1761 | 64-1413 | 1414-1458 | 1459-1761 | Dna |
| Valsaria rubricosa | NN046835 | SEQ ID NO: 177 | 22-586 | 22-471 | 472-486 | 487-586 | Aa |
| Valsaria spartii | NN050508 | SEQ ID NO: 178 | 58-1749 | 58-1410 | 1411-1443 | 1444-1749 | Dna |
| Valsaria spartii | NN050508 | SEQ ID NO: 179 | 20-582 | 20-470 | 471-481 | 482-582 | Aa |

[1)]The sequence comprises both CBM and linker

The alpha-amylase polypeptides may be applied in starch degradation processes and/or used as donors of catalytic domain and/or CBM for a hybrid polypeptide. A preferred polypeptide of the invention, e.g., a hybrid polypeptide, comprises a first amino acid sequence comprising a catalytic module having alpha-amylase activity and a second amino acid sequence comprising a carbohydrate-binding module, wherein said second amino acid sequence has at least 60%, at least 70%, at least 80%, at least 85%, at least 90%, such as at least 95% homology to any amino acid sequence selected from the group consisting of amino acids 529-626 in SEQ ID NO: 159, the amino acids 533-630 in SEQ ID NO: 161, the amino acids 508-602 in SEQ ID NO: 163, the amino acids 540-643 in SEQ ID NO: 165, the amino acids 502-566 in SEQ ID NO: 167, the amino acids 513-613 in SEQ ID NO: 169, the amino acids 492-587 in SEQ ID NO: 173, the amino acids 30-287 in SEQ ID NO: 175, the amino acids 487-586 in SEQ ID NO: 177 and the amino acids 482-582 in SEQ ID NO: 179. Further preferred are polypeptides, e.g., hybrid polypeptides, wherein said first amino acid sequence has at least 60%, at least 70%, at least 80%, at least 85%, at least 90%, such as at least 95% homology to any amino acid sequence selected from the group consisting of amino acids 1-441 in SEQ ID NO: 14, the amino acids 1-471 in SEQ ID NO: 18, the amino acids 1-450 in SEQ ID NO: 20, the amino acids 1-445 in SEQ ID NO: 22, the amino acids 1-498 in SEQ ID NO: 26, the amino acids 18-513 in SEQ ID NO: 28, the amino acids 1-507 in SEQ ID NO: 30, the amino acids 1-481 in SEQ ID NO: 32, the amino acids 1-495 in SEQ ID NO: 34, the amino acids 1-477 in SEQ ID NO: 38, the amino acids 1-449 in SEQ ID NO: 42, the amino acids 1-442 in SEQ ID NO: 115, the amino acids 1-441 in SEQ ID NO: 117, the amino acids 1-477 in SEQ ID NO: 125, the amino acids 1-446 in SEQ ID NO: 131, the amino acids 41-481 in SEQ ID NO: 157, the amino acids 22-502 in SEQ ID NO: 159, the amino acids 24-499 in SEQ ID NO: 161, the amino acids 27-492 in SEQ ID NO: 163, the amino acids 21-496 in SEQ ID NO: 165, the amino acids 29-501 in SEQ ID NO: 167, the amino acids 22-487 in SEQ ID NO: 169, the amino acids 21-463 in SEQ ID NO: 171, the amino acids 21-477 in SEQ ID NO: 173, the amino acids 288-773 in SEQ ID NO: 175, the amino acids 22-471 in SEQ ID NO: 177 and the amino acids 20-470 in SEQ ID NO: 179. Also preferred are polypeptides, e.g., hybrid polypeptides, wherein a linker sequence is present in a position between said first and said second amino acid sequence, said linker sequence having at least 60%, at least 70%, at least 80%, at least 85%, at least 90%, such as at least 95% homology to any amino acid sequence selected from the group consisting of as amino acids 503-528 in SEQ ID NO: 159, amino acids 500-532 in SEQ ID NO: 161, amino acids 493-507 in SEQ ID NO: 163, amino acids 497-539 in SEQ ID NO: 165, amino acids 488-512 in SEQ ID NO: 169 in 478-491 in SEQ ID NO: 173, amino acids 472-486 in SEQ ID NO: 177 and amino acids 471-481 in SEQ ID NO: 179.

Alpha-Amylase Sequence

Catalytic domains, i.e., alpha-amylase catalytic domains (in particular acid stable alpha-amylases), which are appropriate for construction of polypeptides of the types of the present invention may be derived from any organism, preferred are those of fungal or bacterial origin.

Preferably the alpha-amylase is a wild type enzyme. More preferably the alpha-amylase is a variant alpha-amylases comprising amino acid modifications leading to increased activity, increased protein stability at low pH, and/or at high pH, increased stability towards calcium depletion, and/or increased stability at elevated temperature.

Relevant alpha-amylases for use in a hybrid of the invention include alpha-amylases obtainable from a species selected from the list consisting of *Absidia*, *Acremonium*, *Aspergillus*, *Coniochaeta*, *Coniochaeta*, *Cryptosporiopsis*, *Dichotomocladium*, *Dinemasporium* sp., *Diplodia*, *Fusarium*, *Gliocladium*, *Malbranchea*, *Meripilus Trametes*, *Nectria*, *Nectria*, *Penicillium*, *Phanerochaete*, *Rhizomucor*, *Rhizopus*, *Streptomyces*, *Subulispora*, *Syncephalastrum*, *Thaminidium*, *Thermoascus*, *Thermomyces*, *Trametes*, *Trichophaea* and *Valsaria*. The alpha-amylases catalytic domain may also be derived from a bacteria, e.g., *Bacillus*.

Preferably the alpha-amylases amino acid sequence selected is derived from any species selected from the group consisting of *Absidia cristata*, *Acremonium* sp., *Aspergillus* niger, Aspergillus kawachii, Aspergillus oryzae, Coniochaeta sp., Coniochaeta sp., Cryptosporiopsis sp., Dichotomocladium hesseltinei, Dinemasporium sp., Diplodia sp., Fusarium sp., Gliocladium sp., Malbranchea sp., Meripilus giganteus, Nectria sp., Nectria sp., Penicillium sp., Phanerochaete chrysosporium, Rhizomucor pusillus, Rhizopus oryzae, Stereum sp. Streptomyces thermocyaneoviolaceus, Streptomyces limosus, Subulispora procurvata, Syncephalastrum racemosum, Thaminidium elegans, Thermoascus aurantiacus, Thermoascus sp., Thermomyces lanuginosus, Trametes corrugata, Trametes sp., Trichophaea saccata, Valsaria rubricosa, Valsaria spartii and Bacillus flavothermus (Syn. Anoxybacillus contaminans).

Preferably the hybrid comprises an alpha-amylase amino acid sequence selected from the group consisting of the alpha-amylase catalytic modules listed in table 1 or 2.

Most preferably the hybrid comprises an alpha-amylase amino acid sequence selected from the group consisting of the alpha-amylases from Aspergillus niger (SEQ ID NO: 2), Aspergillus oryzae (SEQ ID NO: 4 and SEQ ID NO: 6), Trichophaea saccata (SEQ ID NO: 8), Subulispora procurvata (SEQ ID NO: 10), Valsaria rubricosa (SEQ ID NO: 12), Thermomyces lanuginosus (SEQ ID NO: 14), Acremonium sp. (SEQ ID NO: 16), Malbranchea sp. (SEQ ID NO: 18), Rhizomucor pusillus (SEQ ID NO: 20), Dichotomocladium hesseltinei (SEQ ID NO: 22), Meripilus giganteus (SEQ ID NO: 24), Stereum sp. AMY1179 (SEQ ID NO: 26), Trametes sp. (SEQ ID NO: 28), Coriolus censors (SEQ ID NO: 30), Dinemasporium sp. (SEQ ID NO: 32), Cryptosporiopsis sp. (SEQ ID NO: 34), Coniochaeta sp. (SEQ ID NO: 36), Diplodia sp. (SEQ ID NO: 38), Nectria sp. (SEQ ID NO: 40), Gliocladium sp. (SEQ ID NO: 42), Streptomyces thermocyaneoviolaceus (SEQ ID NO: 44), Thermoascus sp. II (SEQ ID NO: 111), Coniochaeta sp. (SEQ ID NO: 113), Nectria sp. (SEQ ID NO: 115), Fusarium sp. (SEQ ID NO: 117), Trametes corrugata (SEQ ID NO: 119), Penicillium sp. (SEQ ID NO: 121), Valsaria spartii (SEQ ID NO: 123), Thermoascus aurantiacus (SEQ ID NO: 125), Phanerochaete chrysosporium (SEQ ID NO: 127), Rhizopus oryzae (SEQ ID NO: 129), Thaminidium elegans (SEQ ID NO: 131), Absidia cristata (SEQ ID NO: 133), Syncephalastrum racemosum (SEQ ID NO: 135) and Streptomyces limosus (SEQ ID NO: 155).

Also preferred for the invention are hybrids comprising a alpha-amylase amino acid sequence having at least 60%, at least 65%, at least 70%, at least 75%, at least 80%, at least 85%, at least 90% or even at least 95% homology to any sequence selected from the group consisting of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 111, SEQ ID NO: 113, SEQ ID NO: 115, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135 and SEQ ID NO: 155.

In another preferred embodiment the hybrid enzyme has a alpha-amylase sequence which differs from an amino acid sequences selected from the group consisting of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 111, SEQ ID NO: 113, SEQ ID NO: 115, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135 and SEQ ID NO: 155 in no more than 10 positions, no more than 9 positions, no more than 8 positions, no more than 7 positions, no more than 6 positions, no more than 5 positions, no more than 4 positions, no more than 3 positions, no more than 2 positions, or even no more than 1 position.

Also preferred are hybrids comprising a alpha-amylases amino acid sequence encoded by a DNA sequence having at least 50%, at least 60%, at least 65%, at least 70%, at least 75%, at least 80%, at least 85%, at least 90% or even at least 95% homology to any sequence selected from the group consisting of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134 and SEQ ID NO: 154.

Further preferred are hybrids comprising a alpha-amylase encoded by a DNA sequence hybridizing under low, medium, medium/high, high and/or very high stringency to any DNA sequence selected from the group consisting of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134 and SEQ ID NO: 154.

Linker Sequence

The linker sequence may be any suitable linker sequence, e.g., a linker sequence derived from an alpha-amylase or a glucoamylase. The linker may be a bond, or a short linking group comprising from about 2 to about 100 carbon atoms, in particular of from 2 to 40 carbon atoms. However, the linker is preferably a sequence of from about 2 to about 100 amino acid residues, more preferably of from 4 to 40 amino acid residues, such as from 6 to 15 amino acid residues.

Preferably the hybrids comprising a linker sequence derived from any species selected from the group consisting of Acremonium, Coniochaeta, Coniochaeta, Meripilus, Pachykytospora, Penicillium, Sublispora, Trametes, Trichophaea, Valsaria, Athelia, Aspergillus, Trametes and Leucopaxillus. The linker may also be derived from a bacterium, e.g., from a strain within Bacillus sp. More the preferably linker is derived from a species selected from the group consisting of Acremonium sp., Coniochaeta sp., Coniochaeta sp., Meripilus giganteus, Penicillium sp., Sublispora provurvata, Trametes corrugata, Trichophaea saccata, Valsaria rubricosa, Valsario spartii, Aspergillus kawachii, Aspergillus niger, Athelia rolfsii, Leucopaxillus gigantus, Pachykytospora papayracea, Trametes cingulata and Bacillus flavothermus.

Preferably the hybrid comprises a linker amino acid sequence selected from the group consisting of the linkers listed in table 1 or 2.

More preferably the linker is a linker from a glucoamylase selected from the group consisting of *Pachykytospora papayracea* (SEQ ID NO: 46), *Trametes cingulata* (SEQ ID NO: 48), *Leucopaxillus gigantus* (SEQ ID NO: 50), *Athelia rolfsii* (SEQ ID NO: 68), *Aspergillus kawachii* (SEQ ID NO: 70), *Aspergillus niger* (SEQ ID NO: 72) or a linker from an alpha-amylase selected from the group consisting of *Sublispora provurvata* (SEQ ID NO: 54), *Valsaria rubricosa* (SEQ ID NO: 56), *Acremonium* sp. (SEQ ID NO: 58), *Meripilus giganteus* (SEQ ID NO: 60), *Bacillus flavothermus* (SEQ ID NO: 62, SEQ ID NO: 64 or SEQ ID NO: 66), *Coniochaeta* sp. AM603 (SEQ ID NO: 74), *Coniochaeta* sp. (SEQ ID NO: 145), *Trametes corrugata* (SEQ ID NO: 147), *Valsario spartii* (SEQ ID NO: 149), *Penicillium* sp. (SEQ ID NO: 151), *Trichophaea saccata* (SEQ ID NO: 52).

Also preferred for the invention is any linker amino acid sequence having at least 60%, at least 65%, at least 70%, at least 75%, at least 80%, at least 85%, at least 90% or even at least 95% homology to any sequence selected from the group consisting of SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 145, SEQ ID NO: 147, SEQ ID NO: 149 and SEQ ID NO: 151.

In another preferred embodiment the hybrid enzyme has a linker sequence which differs from an amino acid sequences selected from the group consisting of SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 145, SEQ ID NO: 147, SEQ ID NO: 149 and SEQ ID NO: 151 in no more than 10 positions, no more than 9 positions, no more than 8 positions, no more than 7 positions, no more than 6 positions, no more than 5 positions, no more than 4 positions, no more than 3 positions, no more than 2 positions, or even no more than 1 position.

Also preferred are the hybrids comprising a linker sequence encoded by a DNA sequence having at least 60%, at least 65%, at least 70%, at least 75%, at least 80%, at least 85%, at least 90% or even at least 95% homology to any sequence selected from the group consisting of SEQ ID NO: 45, SEQ ID NO: 47, SEQ ID NO: 49, SEQ ID NO: 51, SEQ ID NO: 53, SEQ ID NO: 55, SEQ ID NO: 57, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 144, SEQ ID NO: 146, SEQ ID NO: 148, and SEQ ID NO: 150.

Further preferred are the hybrids comprising a linker sequence encoded by a DNA sequence hybridizing under high, medium or low stringency to any DNA sequence selected from the group consisting SEQ ID NO: 45, SEQ ID NO: 47, SEQ ID NO: 49, SEQ ID NO: 51, SEQ ID NO: 53, SEQ ID NO: 55, SEQ ID NO: 57, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 144, SEQ ID NO: 146, SEQ ID NO: 148, and SEQ ID NO: 150.

In preferred embodiments the linker originating from the CBM source is used, e.g., when using the CBM from *A. rolfsii* glucoamylase the linker sequence from the *A. rolfsii* glucoamylase is used in the hybrid as well.

Carbohydrate-Binding Modules

A carbohydrate-binding module (CBM), or as often referred to, a carbohydrate-binding domain (CBM), is a polypeptide amino acid sequence which binds preferentially to a poly- or oligosaccharide (carbohydrate), frequently—but not necessarily exclusively—to a water-insoluble (including crystalline) form thereof.

CBMs derived from starch degrading enzymes are often referred to as starch-binding modules or SBMs (CBMs which may occur in certain amylolytic enzymes, such as certain glucoamylases (GA), or in enzymes such as cyclodextrin glucanotransferases, or in alpha-amylases). Likewise, other sub-classes of CBMs would embrace, e.g., cellulose-binding modules (CBMs from cellulolytic enzymes), chitin-binding modules (CBMs which typically occur in chitinases), xylan-binding modules (CBMs which typically occur in xylanases), mannan-binding modules (CBMs which typically occur in mannanases). SBMs are often referred to as SBDs (Starch Binding Domains).

CBMs are found as integral parts of large polypeptides or proteins consisting of two or more polypeptide amino acid sequence regions, especially in hydrolytic enzymes (hydrolases) which typically comprise a catalytic module containing the active site for substrate hydrolysis and a carbohydrate-binding module (CBM) for binding to the carbohydrate substrate in question. Such enzymes can comprise more than one catalytic module and one, two or three CBMs and optionally further comprise one or more polypeptide amino acid sequence regions linking the CBM(s) with the catalytic module(s), a region of the latter type usually being denoted a "linker". Examples of hydrolytic enzymes comprising a CBM—some of which have already been mentioned above—are cellulases, xylanases, mannanases, arabinofuranosidases, acetylesterases and chitinases. CBMs have also been found in algae, e.g., in the red alga *Porphyra purpurea* in the form of a non-hydrolytic polysaccharide-binding protein.

In proteins/polypeptides in which CBMs occur (e.g., enzymes, typically hydrolytic enzymes), a CBM may be located at the N or C terminus or at an internal position.

That part of a polypeptide or protein (e.g., hydrolytic enzyme) which constitutes a CBM per se typically consists of more than about 30 and less than about 250 amino acid residues.

The "Carbohydrate-Binding Module of Family 20" or a CBM-20 module is in the context of this invention defined as a sequence of approximately 100 amino acids having at least 45% homology to the Carbohydrate-Binding Module (CBM) of the polypeptide disclosed in FIG. 1 by Joergensen et al., 1997, *Biotechnol. Lett.* 19:1027-1031. The CBM comprises the last 102 amino acids of the polypeptide, i.e., the subsequence from amino acid 582 to amino acid 683. The numbering of Glycoside Hydrolase Families applied in this disclosure follows the concept of Coutinho & Henrissat, 1999, *CAZy—Carbohydrate-Active Enzymes server* at afmb.cnrs-mrs.fr/~cazy/CAZY/index.html or alternatively Coutinho and Henrissat, 1999, The modular structure of cellulases and other carbohydrate-active enzymes: an integrated database approach. In "*Genetics, Biochemistry and Ecology of Cellulose Degradation*", K. Ohmiya, K. Hayashi, K. Sakka, Y. Kobayashi, S. Karita and T. Kimura eds., Uni Publishers Co., Tokyo, pp. 15-23 and Bourne and Henrissat, 2001; Glycoside hydrolases and glycosyltransferases: families and functional modules, *Current Opinion in Structural Biology* 11:593-600.

Examples of enzymes which comprise a CBM suitable for use in the context of the invention are alpha-amylases, maltogenic alpha-amylases, cellulases, xylanases, mannanases, arabinofuranosidases, acetylesterases and chitinases. Further CBMs of interest in relation to the present invention include CBMs deriving from glucoamylases (EC 3.2.1.3) or from CGTases (EC 2.4.1.19).

CBMs deriving from fungal, bacterial or plant sources will generally be suitable for use in the hybrid of the invention. Preferred are CBMs of fungal origin. In this connection, techniques suitable for isolating the relevant genes are well known in the art.

Preferred hybrids comprise a CBM of Carbohydrate-Binding Module Family 20, 21 or 25. CBMs of Carbohydrate-Binding Module Family 20 suitable for the invention may be derived from glucoamylases of *Aspergillus awamori* (SWISSPROT Q12537), *Aspergillus kawachii* (SWISSPROT P23176), *Aspergillus niger* (SWISSPROT P04064), *Aspergillus oryzae* (SWISSPROT P36914), from alpha-amylases of *Aspergillus kawachii* (EMBL:#AB008370), *Aspergillus nidulans* (NCBI AAF17100.1), from beta-amylases of *Bacillus cereus* (SWISSPROT P36924), or from CGTases of *Bacillus circulans* (SWISSPROT P43379). Preferred is a CBM from the alpha-amylase of *Aspergillus kawachii* (EMBL:#AB008370) as well as CBMs having at least 60%, at least 65%, at least 70%, at least 75%, at least 80%, at least 85%, at least 90% or even at least 95% homology to the CBM of the alpha-amylase of *Aspergillus kawachii* (EMBL:#AB008370). Further preferred CBMs include the CBMs of the glucoamylase from *Hormoconis* sp. such as from *Hormoconis resinae* (Syn. Creosote fungus or *Amorphotheca resinae*) such as the CBM of SWISSPROT: Q03045, from *Lentinula* sp. such as from *Lentinula edodes* (shiitake mushroom) such as the CBM of SPTREMBL: Q9P4C5, from *Neurospora* sp. such as from *Neurospora crassa* such as the CBM of SWISSPROT:P14804, from *Talaromyces* sp. such as from *Talaromyces byssochlamydioides*, from *Geosmithia* sp. such as from *Geosmithia cylindrospora*, from *Scorias* sp. such as from *Scorias spongiosa*, from *Eupenicillium* sp. such as from *Eupenicillium ludwigii*, from *Aspergillus* sp. such as from *Aspergillus japonicus*, from *Penicillium* sp. such as from *Penicillium* cf. *miczynskii*, from *Thysanophora* sp., and from *Humicola* sp. such as from *Humicola grisea* var. *thermoidea* such as the CBM of SPTREMBL:Q12623.

Preferably the hybrid comprises a CBM which is derived from any family or species selected from the group consisting of *Acremonium, Aspergillus, Athelia, Coniochaeta, Cryptosporiopsis, Dichotomocladium, Dinemasporium, Diplodia, Gliocladium, Leucopaxillus, Malbranchea, Meripilus, Nectria, Pachykytospora, Penicillium, Rhizomucor, Rhizomucor pusillus, Streptomyces, Subulispora, Thermomyces, Trametes, Trichophaea saccata* and *Valsaria*. The CBM may also be derived from a plant, e.g., from corn (e.g., *Zea mays*) or a bacterial, e.g., *Bacillus*. More preferably the hybrid comprises a CBM derived from any species selected from the group consisting of *Acremonium* sp., *Aspergillus kawachii, Aspergillus niger, Aspergillus oryzae, Athelia rolfsii, Bacillus flavothermus, Coniochaeta* sp., *Cryptosporiopsis* sp., *Dichotomocladium hesseltinei, Dinemasporium* sp., *Diplodia* sp., *Gliocladium* sp., *Leucopaxillus gigantus, Malbranchea* sp, *Meripilus giganteus, Nectria* sp., *Pachykytospora papayracea, Penicillium* sp., *Rhizomucor pusillus, Streptomyces thermocyaneoviolaceus, Streptomyces limosus, Subulispora provurvata, Thermomyces lanuginosus, Trametes cingulata, Trametes corrugata, Trichophaea saccata, Valsaria rubricosa, Valsario spartii* and *Zea mays*.

Preferably the hybrid comprises a CBM amino acid sequence selected from the group consisting of the CBMs listed in table 1 or 2.

Most preferably the hybrid comprises a CBM from a glucoamylase selected from the group consisting of the *Pachykytospora papayracea* (SEQ ID NO: 76), *Trametes cingulata* (SEQ ID NO: 78), *Leucopaxillus gigantus* (SEQ ID NO: 80), *Athelia rolfsii* (SEQ ID NO: 92), *Aspergillus kawachii* (SEQ ID NO: 94), *Aspergillus niger* (SEQ ID NO: 96) or from a alpha-amylase selected from the group consisting of *Trichopheraea saccata* (SEQ ID NO: 52), *Subulispora provurvata* (SEQ ID NO: 82), *Valsaria rubricosa* (SEQ ID NO: 84), *Acremonium* sp. (SEQ ID NO: 86), *Meripilus giganteus* (SEQ ID NO: 88), *Bacillus flavothermus* (SEQ ID NO: 90), *Coniochaeta* sp. (SEQ ID NO: 98), *Zea mays* (SEQ ID NO: 109), *Coniochaeta* sp. (SEQ ID NO: 137), *Trametes corrugata* (SEQ ID NO: 139), *Valsario spartii* (SEQ ID NO: 141) and *Penicillium* sp. (SEQ ID NO: 143).

In another preferred embodiment the hybrid enzyme has a CBM sequence which differs from an amino acid sequences selected from the group consisting of SEQ ID NO: 52, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92, SEQ ID NO: 94, SEQ ID NO: 96, SEQ ID NO: 98, SEQ ID NO: 109, SEQ ID NO: 137, SEQ ID NO: 139, SEQ ID NO: 141 and SEQ ID NO: 143 in no more than 10 positions, no more than 9 positions, no more than 8 positions, no more than 7 positions, no more than 6 positions, no more than 5 positions, no more than 4 positions, no more than 3 positions, no more than 2 positions, or even no more than 1 position.

Also preferred are any CBM encoded by a DNA sequence having at least 60%, at least 65%, at least 70%, at least 75%, at least 80%, at least 85%, at least 90% or even at least 95% homology to any sequence selected from the group consisting of SEQ ID NO: 75, SEQ ID NO: 77, SEQ ID NO: 79, SEQ ID NO: 81, SEQ ID NO: 83, SEQ ID NO: 85, SEQ ID NO: 87, SEQ ID NO: 89, SEQ ID NO: 91, SEQ ID NO: 93, SEQ ID NO: 95, SEQ ID NO: 97, SEQ ID NO: 108, SEQ ID NO: 136, SEQ ID NO: 138, SEQ ID NO: 140 and SEQ ID NO: 142. Further preferred are any CBM encoded by a DNA sequence hybridizing under high, medium or low stringency to any DNA sequence selected from the group consisting of SEQ ID NO: 75, SEQ ID NO: 77, SEQ ID NO: 79, SEQ ID NO: 81, SEQ ID NO: 83, SEQ ID NO: 85, SEQ ID NO: 87, SEQ ID NO: 89, SEQ ID NO: 91, SEQ ID NO: 93, SEQ ID NO: 95, SEQ ID NO: 97, SEQ ID NO: 108, SEQ ID NO: 136, SEQ ID NO: 138, SEQ ID NO: 140 and SEQ ID NO: 142.

Further suitable CBMs of Carbohydrate-Binding Module Family 20, 21 or 25 may be found at afmb.cnrs-mrs.fr/~cazy/CAZY/index.html).

Once a nucleotide sequence encoding the substrate-binding (carbohydrate-binding) region has been identified, either as cDNA or chromosomal DNA, it may then be manipulated in a variety of ways to fuse it to a DNA sequence encoding the polypeptide of interest. The DNA fragment encoding the carbohydrate-binding amino acid sequence and the DNA encoding the polypeptide of interest are then ligated with or without a linker. The resulting ligated DNA may then be manipulated in a variety of ways to achieve expression.

Particular Embodiments

In a preferred embodiment the polypeptide comprises a CDM derived from *Athelia rolfsii, Pachykytospora papayracea, Valsaria rubricosa* or *Meripilus giganteus*. Preferred are any polypeptide comprising a CBM amino acid sequence selected from the group consisting of *Athelia rolfsii* glucoamylase (SEQ ID NO: 92), the *Pachykytospora papayracea* glucoamylase (SEQ ID NO: 76), the *Valsaria rubricosa* alpha-amylase (SEQ ID NO: 84) and the *Meripilus giganteus* alpha-amylase (SEQ ID NO: 88).

In yet a preferred embodiment the polypeptide comprises an alpha-amylase sequence derived from the *A. oryzae* acid alpha-amylase (SEQ ID NO: 4), Preferably the wherein said *A. oryzae* amino acid sequence comprises one or more amino acid substitutions selected from the group consisting of A128P, K138V, S141N, Q143A, D144S, Y155W, E156D, D157N, N244E, M246L, G446D, D448S and N450D. Most preferably the polypeptide comprises an catalytic domain having the amino acid sequence shown in SEQ ID NO: 6. In a preferred embodiment the polypeptide further comprises a CBM derived from *A. rolfsii*, Preferably the polypeptide further comprises a CBM having the amino acid sequence shown in SEQ ID NO: 92. Most preferably the polypeptide has the amino acid sequence shown in SEQ ID NO: 100 or the polypeptide has an amino acid sequence having at least 60%, at least 65%, at least 70%, at least 75%, at least 80%, at least 85%, at least 90% or even at least 95% homology to the afore mentioned amino acid sequence.

Also preferred is any polypeptide encoded by a DNA sequence having at least 60%, at least 65%, at least 70%, at least 75%, at least 80%, at least 85%, at least 90% or even at least 95% homology to the DNA sequence shown in SEQ ID NO: 99.

In another preferred embodiment the polypeptide comprises a catalytic module derived from the *Rhizomucor pusillus* alpha-amylase and/or a CBM derived from *A. rolfsii*. In a particular preferred embodiment the polypeptide has the amino acid sequence shown in SEQ ID NO: 101 or the polypeptide has an amino acid sequence having at least 60%, at least 65%, at least 70%, at least 75%, at least 80%, at least 85%, at least 90% or even at least 95% homology to any of the afore mentioned amino acid sequence.

In yet a preferred embodiment the polypeptide comprises a catalytic module derived from the *Meripilus giganteus* alpha-amylase and/or a CBM derived from *A. rolfsii*. In a particular preferred embodiment the polypeptide has the amino acid sequence shown in SEQ ID NO: 102 or the polypeptide has an amino acid sequence having at least 60%, at least 65%, at least 70%, at least 75%, at least 80%, at least 85%, at least 90% or even at least 95% homology to the afore mentioned amino acid sequence.

In yet another preferred embodiment the polypeptide has an amino acid sequence which differs from any the amino acid sequence amino acid sequences shown in SEQ ID NO: 100, SEQ ID NO: 101 and SEQ ID NO: 102 in no more than 10 positions, no more than 9 positions, no more than 8 positions, no more than 7 positions, no more than 6 positions, no more than 5 positions, no more than 4 positions, no more than 3 positions, no more than 2 positions, or even no more than 1 position.

Also preferred are any polypeptide encoded by a DNA sequence having at least 60%, at least 65%, at least 70%, at least 75%, at least 80%, at least 85%, at least 90% or even at least 95% homology to any sequence DNA sequence encoding any the amino acid sequence amino acid sequences shown in SEQ ID NO: 100, SEQ ID NO: 101 and SEQ ID NO: 102.

Further preferred are any CBM encoded by a DNA sequence which hybridizing under high, medium or low stringency to any DNA sequence encoding any of the amino acid sequence amino acid sequences shown in SEQ ID NO: 100, SEQ ID NO: 101 and SEQ ID NO: 102.

Other preferred embodiments of the polypeptides of the invention are shown in table 3, 4, 5 and 6 in the examples section. Also preferred is any polypeptide having at least 70%, more preferred at least 80% and even more preferred at least 90% homology to any of the amino acid sequences of the polypeptides shown in tables 1 to 7. Further preferred is any polypeptide encoded by a DNA sequence which hybridizes at low, medium, or high stringency with DNA sequence encoding any of the amino acid sequences of the polypeptides shown in tables 1 to 7.

In a preferred embodiment the polypeptide comprises a catalytic domain having at least 75% homology to the *A. oryzae* catalytic domain (SEQ ID NO: 6) and a CBM having at least 75% homology to a CBM selected from the group consisting of SEQ ID NO: 82, SEQ ID NO: 84, SEQ ID NO: 86, SEQ ID NO: 76, SEQ ID NO: 78, SEQ ID NO: 80, SEQ ID NO: 88, SEQ ID NO: 52, SEQ ID NO: 92, SEQ ID NO: 52, and SEQ ID NO: 90. In a more preferred embodiment the polypeptide comprises the *A. oryzae* catalytic domain (SEQ ID NO: 6) and a CBM selected from the group consisting of SEQ ID NO: 82, SEQ ID NO: 84, SEQ ID NO: 86, SEQ ID NO: 76, SEQ ID NO: 78, SEQ ID NO: 80, SEQ ID NO: 88, SEQ ID NO: 52, SEQ ID NO: 92, SEQ ID NO: 52, SEQ ID NO: 90, SEQ ID NO: 90 and SEQ ID NO: 90.

In a preferred embodiment the polypeptide comprises a CBM having at least 75% homology to the *A. rolfsii* glucoamylase CBM (SEQ ID NO: 92) and a catalytic domain having at least 75% homology to a catalytic domain selected from the group consisting of SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 155, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 111, SEQ ID NO: 113, SEQ ID NO: 115, SEQ ID NO: 117, SEQ ID NO: 119, SEQ ID NO: 123, SEQ ID NO: 125, SEQ ID NO: 121, SEQ ID NO: 127, SEQ ID NO: 129, SEQ ID NO: 131, SEQ ID NO: 133 and SEQ ID NO: 135. In a more preferred embodiment the polypeptide comprises the *A. rolfsii* glucoamylase CBM (SEQ ID NO: 92) and a catalytic domain selected from the group consisting of SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 155, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 111, SEQ ID NO: 113, SEQ ID NO: 115, SEQ ID NO: 117, SEQ ID NO: 119, SEQ ID NO: 123, SEQ ID NO: 125, SEQ ID NO: 121, SEQ ID NO: 127, SEQ ID NO: 129, SEQ ID NO: 131, SEQ ID NO: 133 and SEQ ID NO: 135.

In a preferred embodiment the polypeptide comprises a CBM having at least 75% homology the *Pachykytospora papayracea* glucoamylase CBM in SEQ ID NO: 145 and a catalytic domain having at least 75% homology to a CBM selected from the group consisting of the *Acremonium* sp. alpha-amylase CBM in SEQ ID NO: 16, the *Rhizomucor pusillus* alpha-amylase CBM in SEQ ID NO: 20 and the *Meripilus giganteus* alpha-amylase CBM in SEQ ID NO: 24. In a more preferred embodiment the polypeptide comprises the *Pachykytospora papayracea* glucoamylase CBM in SEQ ID NO: 145 and a CBM selected from the group consisting of the *Acremonium* sp. alpha-amylase CBM in SEQ ID NO: 16, the *Rhizomucor pusillus* alpha-amylase CBM in SEQ ID NO: 20 and the *Meripilus giganteus* alpha-amylase CBM in SEQ ID NO: 24.

In a preferred embodiment the polypeptide comprises a catalytic domain having at least 75% homology to the *Rhizomucor pusillus* alpha-amylase catalytic domain (SEQ ID NO: 20) and a CBM having at least 75% homology to a CBM selected from the group consisting of *Aspergillus* kawachii glucoamylase CBM SEQ ID NO: 94 and the *Aspergillus niger* glucoamylase CBM in SEQ ID NO: 96. In a more preferred embodiment the polypeptide comprises the *Rhizomucor pusillus* alpha-amylase catalytic domain (SEQ ID NO: 20) and a CBM selected from the group consisting of

*Aspergillus* kawachii glucoamylase CBM SEQ ID NO: 94 and the *Aspergillus niger* glucoamylase CBM in SEQ ID NO: 96.

In a preferred embodiment the polypeptide comprises a catalytic domain having at least 75% homology to the *Meripilus giganteus* alpha-amylase catalytic domain (SEQ ID NO: 24) and a CBM having at least 75% homology to a CBM selected from the group consisting of *Pachykytospora papayracea* glucoamylase CBM in SEQ ID NO: 145, the *Valsaria rubricosa* alpha-amylase CBM SEQ ID NO: 84 in and the *Zea mays* CBM in SEQ ID NO: 109. In a more preferred embodiment the polypeptide comprises the *Meripilus giganteus* alpha-amylase catalytic domain (SEQ ID NO: 24) and a CBM selected from the group consisting of *Pachykytospora papayracea* glucoamylase CBM in SEQ ID NO: 145, the *Valsaria rubricosa* alpha-amylase CBM SEQ ID NO: 84 in and the *Zea mays* CBM in SEQ ID NO: 109.

In a preferred embodiment the polypeptide comprises a catalytic domain having at least 75% homology to the *Rhizomucor pusillus* alpha-amylase catalytic domain (SEQ ID NO: 20) and a CBM having at least 75% homology to a CBM selected from the group consisting of the *A. rolfsii* glucoamylase CBM in SEQ ID NO: 92 and the *Zea mays* CBM in SEQ ID NO: 109, the *Coniochaeta* sp. alpha-amylase CBM in SEQ ID NO: 113, the *Trametes corrugata* alpha-amylase CBM in SEQ ID NO: 119, the *Valsaria spartii* alpha-amylase CBM in SEQ ID NO: 123, the *Penicillium* sp. alpha-amylase CBM in SEQ ID NO: 121 and the *Meripulus giganteus* alpha-amylase CBM in SEQ ID NO: 88. In a more preferred embodiment the polypeptide comprises the *Rhizomucor pusillus* alpha-amylase catalytic domain (SEQ ID NO: 20) and a CBM selected from the group consisting of the *A. rolfsii* glucoamylase CBM in SEQ ID NO: 92 and the *Zea mays* CBM in SEQ ID NO: 109, the *Coniochaeta* sp. alpha-amylase CBM in SEQ ID NO: 113, the *Trametes corrugata* alpha-amylase CBM in SEQ ID NO: 119, the *Valsaria spartii* alpha-amylase CBM in SEQ ID NO: 123, the *Penicillium* sp. alpha-amylase CBM in SEQ ID NO: 121 and the *Meripulus giganteus* alpha-amylase CBM in SEQ ID NO: 88.

In a particularly preferred embodiment the polypeptide is selected from the group consisting of V001, V002, V003, V004, V005, V006, V007, V008, V009, V010, V011, V012, V013, V014, V015, V016, V017, V018, V019, V021, V022, V023, V024, V025, V026, V027, V028, V029, V030, V031, V032, V033, V034, V035, V036, V037, V038, V039, V040, V041, V042, V043, V047, V048, V049, V050, V051, V052, V054, V055, V057, V059, V060, V061, V063, V064, V065, V066, V067, V068 and V069.

Expression Vectors

The present invention also relates to recombinant expression vectors which may comprise a DNA sequence encoding the polypeptide, a promoter, a signal peptide sequence and transcriptional and translational stop signals. The various DNA and control sequences described above may be joined together to produce a recombinant expression vector which may include one or more convenient restriction sites to allow for insertion or substitution of the DNA sequence encoding the polypeptide at such sites. Alternatively, the DNA sequence of the present invention may be expressed by inserting the DNA sequence or a DNA construct comprising the sequence into an appropriate vector for expression. In creating the expression vector, the coding sequence is located in the vector so that the coding sequence is operably linked with the appropriate control sequences for expression and possibly secretion.

The recombinant expression vector may be any vector (e.g., a plasmid or virus), which can be conveniently subjected to recombinant DNA procedures and can bring about the expression of the DNA sequence. The choice of the vector will typically depend on the compatibility of the vector with the host cell into which the vector is to be introduced. The vectors may be linear or closed circular plasmids. The vector may be an autonomously replicating vector, i.e., a vector which exists as an extrachromosomal entity, the replication of which is independent of chromosomal replication, e.g., a plasmid, an extrachromosomal element, a minichromosome, a cosmid or an artificial chromosome. The vector may contain any means for assuring self-replication. Alternatively, the vector may be one which, when introduced into the host cell, is integrated into the genome and replicated together with the chromosome(s) into which it has been integrated. The vector system may be a single vector or plasmid or two or more vectors or plasmids which together contain the total DNA to be introduced into the genome of the host cell, or a transposon.

Markers

The vectors of the present invention preferably contain one or more selectable markers, which permit easy selection of transformed cells. A selectable marker is a gene the product of which provides for biocide or viral resistance, resistance to heavy metals, prototrophy to auxotrophs and the like.

Examples of selectable markers for use in a filamentous fungus host cell may be selected from the group including, but not limited to, amdS (acetamidase), argB (ornithine carbamoyltransferase), bar (phosphinothricin acetyltransferase), hygB (hygromycin phosphor-transferase), niaD (nitrate reductase), pyrG (orotidine-5'-phosphate decarboxylase), sC (sulfate adenyltransferase), trpC (anthranilate synthase), and glufosinate resistance markers, as well as equivalents from other species. Preferred for use in an *Aspergillus* cell are the amdS and pyrG markers of *Aspergillus nidulans* or *Aspergillus oryzae* and the bar marker of *Streptomyces hygroscopicus*. Furthermore, selection may be accomplished by co-transformation, e.g., as described in WO 91/17243, where the selectable marker is on a separate vector.

The vectors of the present invention preferably contain an element(s) that permits stable integration of the vector into the host cell genome or autonomous replication of the vector in the cell independent of the genome of the cell.

The vectors of the present invention may be integrated into the host cell genome when introduced into a host cell. For integration, the vector may rely on the DNA sequence encoding the polypeptide of interest or any other element of the vector for stable integration of the vector into the genome by homologous or none homologous recombination. Alternatively, the vector may contain additional DNA sequences for directing integration by homologous recombination into the genome of the host cell. The additional DNA sequences enable the vector to be integrated into the host cell genome at a precise location(s) in the chromosome(s). To increase the likelihood of integration at a precise location, the integrational elements should preferably contain a sufficient number of DNAs, such as 100 to 1,500 base pairs, preferably 400 to 1,500 base pairs, and most preferably 800 to 1,500 base pairs, which are highly homologous with the corresponding target sequence to enhance the probability of homologous recombination. The integrational elements may be any sequence that is homologous with the target sequence in the genome of the host cell. Furthermore, the integrational elements may be non-encoding or encoding DNA sequences. On the other hand, the vector may be integrated into the genome of the host cell by non-homologous recombination. These DNA sequences may be any sequence that is homologous with a target sequence in the genome of the host cell, and, furthermore, may be non-encoding or encoding sequences.

For autonomous replication, the vector may further comprise an origin of replication enabling the vector to replicate autonomously in the host cell in question.

The episomal replicating the AMA1 plasmid vector disclosed in WO 00/24883 may be used.

More than one copy of a DNA sequence encoding a polypeptide of interest may be inserted into the host cell to amplify expression of the DNA sequence. Stable amplification of the DNA sequence can be obtained by integrating at least one additional copy of the sequence into the host cell genome using methods well known in the art and selecting for transformants.

The procedures used to ligate the elements described above to construct the recombinant expression vectors of the present invention are well known to one skilled in the art (see, e.g., Sambrook et al., 1989, Molecular Cloning, A Laboratory Manual, $2^{nd}$ edition, Cold Spring Harbor, N.Y.).

Host Cells

The host cell of the invention, either comprising a DNA construct or an expression vector comprising the DNA sequence encoding the polypeptide, is advantageously used as a host cell in the recombinant production of the polypeptide, e.g., a hybrid enzyme, a wild-type enzyme or a genetically modified wild-type enzyme. The cell may be transformed with an expression vector. Alternatively, the cell may be transformed with the DNA construct of the invention encoding the polypeptide, e.g., a hybrid enzyme, a wild type enzyme or a genetically modified wild type enzyme, conveniently by integrating the DNA construct (in one or more copies) in the host chromosome. Integration of the DNA construct into the host chromosome may be performed according to conventional methods, e.g., by homologous or heterologous recombination.

The host cell may be any appropriate prokaryotic or eukaryotic cell, e.g., a bacterial cell, a filamentous fungus cell, a yeast, a plant cell or a mammalian cell.

In a preferred embodiment, the host cell is a filamentous fungus represented by the following groups of Ascomycota, include, e.g., *Neurospora, Eupenicillium* (=*Penicillium*), *Emericella* (=*Aspergillus*), *Eurotium* (=*Aspergillus*).

In a more preferred embodiment, the filamentous fungus includes all filamentous forms of the subdivision Eumycota and Oomycota (as defined by Hawksworth et al. In, *Ainsworth and Bisby's Dictionary of The Fungi*, $8^{th}$ edition, 1995, CAB International, University Press, Cambridge, UK. The filamentous fungi are characterized by a vegetative mycelium composed of chitin, cellulose, glucan, chitosan, mannan, and other complex polysaccharides. Vegetative growth is by hyphal elongation and carbon catabolism is obligately aerobic.

In an even more preferred embodiment, the filamentous fungus host cell is a cell of a species of, but not limited to a cell selected from the group consisting of a strain belonging to a species of *Aspergillus*, preferably *Aspergillus oryzae*, *Aspergillus niger, Aspergillus awamori, Aspergillus kawachii*, or a strain of *Bacillus*, or a strain of *Fusarium*, such as a strain of *Fusarium oxysporium, Fusarium graminearum* (in the perfect state named *Gribberella zeae*, previously *Sphaeria zeae*, synonym with *Gibberella roseum* and *Gibberella roseum* f. sp. *cerealis*), or *Fusarium sulphureum* (in the prefect state named *Gibberella puricaris*, synonym with *Fusarium trichothecioides, Fusarium bactridioides, Fusarium sambucium, Fusarium roseum*, and *Fusarium roseum* var. *graminearum*), *Fusarium cerealis* (synonym with *Fusarium crookwellense*), or *Fusarium venenatum*.

In a most preferred embodiment, the filamentous fungus host cell is a cell of a strain belonging to a species of *Aspergillus*, preferably *Aspergillus oryzae* or *Aspergillus niger*.

The filamentous fungus host cell may be a wild type filamentous fungus host cell or a variant, a mutant or a genetically modified filamentous fungus host cell. In a preferred embodiment of the invention the host cell is a protease deficient or protease minus strain. Also specifically contemplated is *Aspergillus* strains, such as *Aspergillus niger* strains, genetically modified to disrupt or reduce expression of glucoamylase, acid-stable alpha-amylase, alpha-1,6 transglucosidase, and protease activities.

Transformation of Filamentous Fungus Host Cells

Filamentous fungus host cells may be transformed by a process involving protoplast formation, transformation of the protoplasts, and regeneration of the cell wall in a manner known in the art. Suitable procedures for transformation of *Aspergillus* host cells are described in EP 0238023, EP 0184438, and Yelton et al., 1984, *Proceedings of the National Academy of Sciences USA* 81:1470-1474. A suitable method of transforming *Fusarium* species is described by Malardier et al., 1989, *Gene* 78:147-156 or U.S. Pat. No. 6,060,305.

Isolating and Cloning a DNA Sequence Encoding a Parent Alpha-Amylase

The techniques used to isolate or clone a DNA sequence encoding a polypeptide of interest are known in the art and include isolation from genomic DNA, preparation from cDNA, or a combination thereof. The cloning of the DNA sequences of the present invention from such genomic DNA can be effected, e.g., by using the well known polymerase chain reaction (PCR) or antibody screening of expression libraries to detect cloned DNA fragments with shared structural features. See, e.g., Innis et al., 1990, *PCR: A Guide to Methods and Application*, Academic Press, New York. Other DNA amplification procedures such as ligase chain reaction (LCR), ligated activated transcription (LAT) and DNA sequence-based amplification (NASBA) may be used.

The DNA sequence encoding a parent alpha-amylase may be isolated from any cell or microorganism producing the alpha-amylase in question, using various methods well known in the art. First, a genomic DNA and/or cDNA library should be constructed using chromosomal DNA or messenger RNA from the organism that produces the alpha-amylase to be studied. Then, if the amino acid sequence of the alpha-amylase is known, labeled oligonucleotide probes may be synthesized and used to identify alpha-amylase-encoding clones from a genomic library prepared from the organism in question. Alternatively, a labelled oligonucleotide probe containing sequences homologous to another known alpha-amylase gene could be used as a probe to identify alpha-amylase-encoding clones, using hybridization and washing conditions of very low to very high stringency.

Yet another method for identifying alpha-amylase-encoding clones would involve inserting fragments of genomic DNA into an expression vector, such as a plasmid, transforming alpha-amylase-negative bacteria with the resulting genomic DNA library, and then plating the transformed bacteria onto agar containing a substrate for alpha-amylase (i.e., maltose), thereby allowing clones expressing the alpha-amylase to be identified.

Alternatively, the DNA sequence encoding the polypeptide may be prepared synthetically by established standard methods, e.g., the phosphoroamidite method described in Beaucage and Caruthers, 1981, *Tetrahedron Letters* 22: 1859-1869, or the method described by Matthes et al., 1984, *EMBO J.* 3: 801-805. In the phosphoroamidite method, oligonucleotides are synthesized, e.g., in an automatic DNA synthesizer, purified, annealed, ligated and cloned in appropriate vectors.

Finally, the DNA sequence may be of mixed genomic and synthetic origin, mixed synthetic and cDNA origin or mixed genomic and cDNA origin, prepared by ligating fragments of synthetic, genomic or cDNA origin (as appropriate, the fragments corresponding to various parts of the entire DNA sequence), in accordance with standard techniques. The DNA sequence may also be prepared by polymerase chain reaction (PCR) using specific primers, for instance as described in U.S. Pat. No. 4,683,202 or Saiki et al., 1988, *Science* 239: 487-491.

Isolated DNA Sequence

The present invention relates, inter alia, to an isolated DNA sequence comprising a DNA sequence encoding a polypeptide, e.g., a hybrid enzyme, a wild type enzyme or a genetically modified wild type enzyme comprising an amino acid sequence of a catalytic module having alpha-amylase activity and an amino acid sequence of a carbohydrate-binding module, wherein the catalytic module is of fungal origin.

The term "isolated DNA sequence" as used herein refers to a DNA sequence, which is essentially free of other DNA sequences, e.g., at least about 20% pure, preferably at least about 40% pure, more preferably at least about 60% pure, even more preferably at least about 80% pure, and most preferably at least about 90% pure as determined by agarose electrophoresis.

For example, an isolated DNA sequence can be obtained by standard cloning procedures used in genetic engineering to relocate the DNA sequence from its natural location to a different site where it will be reproduced. The cloning procedures may involve excision and isolation of a desired DNA fragment comprising the DNA sequence encoding the polypeptide of interest, insertion of the fragment into a vector molecule, and incorporation of the recombinant vector into a host cell where multiple copies or clones of the DNA sequence will be replicated. An isolated DNA sequence may be manipulated in a variety of ways to provide for expression of the polypeptide of interest. Manipulation of the DNA sequence prior to its insertion into a vector may be desirable or necessary depending on the expression vector. The techniques for modifying DNA sequences utilizing recombinant DNA methods are well known in the art.

DNA Construct

The present invention relates, inter alia, to a DNA construct comprising a DNA sequence encoding a polypeptide, e.g., a hybrid enzyme comprising a first amino acid sequence comprising a catalytic module having alpha-amylase activity and a second amino acid sequence comprising a carbohydrate-binding module or a wild type enzyme comprising a first amino acid sequence comprising a catalytic module having alpha-amylase activity and a second amino acid sequence comprising a carbohydrate-binding module. "DNA construct" is defined herein as a DNA molecule, either single- or double-stranded, which is isolated from a naturally occurring gene or which has been modified to contain segments of DNA, which are combined and juxtaposed in a manner, which would not otherwise exist in nature. The term DNA construct is synonymous with the term expression cassette when the DNA construct contains all the control sequences required for expression of a coding sequence of the present invention.

Site-Directed Mutagenesis

Once a parent alpha-amylase-encoding DNA sequence has been isolated, and desirable sites for mutation identified, mutations may be introduced using synthetic oligonucleotides. These oligonucleotides contain nucleotide sequences flanking the desired mutation sites. In a specific method, a single-stranded gap of DNA, the alpha-amylase-encoding sequence, is created in a vector carrying the alpha-amylase gene. Then the synthetic nucleotide, bearing the desired mutation, is annealed to a homologous portion of the single-stranded DNA. The remaining gap is then filled in with DNA polymerase I (Klenow fragment) and the construct is ligated using T4 ligase. A specific example of this method is described in Morinaga et al., 1984, *Biotechnology* 2: 646-639. U.S. Pat. No. 4,760,025 discloses the introduction of oligonucleotides encoding multiple mutations by performing minor alterations of the cassette. However, an even greater variety of mutations can be introduced at any one time by the Morinaga method, because a multitude of oligonucleotides, of various lengths, can be introduced.

Another method for introducing mutations into alpha-amylase-encoding DNA sequences is described in Nelson and Long, 1989, *Analytical Biochemistry* 180: 147-151. It involves the 3-step generation of a PCR fragment containing the desired mutation introduced by using a chemically synthesized DNA strand as one of the primers in the PCR reactions. From the PCR-generated fragment, a DNA fragment carrying the mutation may be isolated by cleavage with restriction endonucleases and reinserted into an expression plasmid.

Localized Random Mutagenesis

The random mutagenesis may be advantageously localized to a part of the parent alpha-amylase in question. This may, e.g., be advantageous when certain regions of the enzyme have been identified to be of particular importance for a given property of the enzyme, and when modified are expected to result in a variant having improved properties. Such regions may normally be identified when the tertiary structure of the parent enzyme has been elucidated and related to the function of the enzyme.

The localized or region-specific, random mutagenesis is conveniently performed by use of PCR generated mutagenesis techniques as described above or any other suitable technique known in the art. Alternatively, the DNA sequence encoding the part of the DNA sequence to be modified may be isolated, e.g., by insertion into a suitable vector, and said part may be subsequently subjected to mutagenesis by use of any of the mutagenesis methods discussed above.

Variants of Hybrid or Wild-Type Enzymes

The performance in a starch degradation process of a wild type or hybrid enzyme comprising a carbohydrate-binding module ("CBM") and an alpha-amylase catalytic module may be improved through protein engineering, such as by site directed mutagenesis, by localized random mutagenesis, by synthetically preparing a new variant of the parent wild type enzyme or parent hybrid enzyme, or by any other suitable protein engineering techniques.

The variants may be produced using conventional protein engineering techniques.

Expression of the Polypeptides in a Host Cell

The nucleotide sequence to be introduced into the DNA of the host cell may be integrated in nucleic acid constructs comprising the nucleotide sequence operably linked to one or more control sequences that direct the expression of the coding sequence in a suitable host cell under conditions compatible with the control sequences.

A nucleotide sequence encoding a polypeptide may be manipulated in a variety of ways to provide for expression of the polypeptide. Manipulation of the nucleotide sequence prior to its insertion into a vector may be desirable or necessary depending on the expression vector. The techniques for modifying nucleotide sequences utilizing recombinant DNA methods are well known in the art.

The control sequence may be an appropriate promoter sequence, a nucleotide sequence which is recognized by a host cell for expression of the nucleotide sequence. The promoter sequence contains transcriptional control sequences, which mediate the expression of the polypeptide. The promoter may be any nucleotide sequence which shows transcriptional activity in the host cell of choice including mutant, truncated, and hybrid promoters, and may be obtained from genes encoding extracellular or intracellular polypeptides either homologous or heterologous to the host cell.

Examples of suitable promoters for directing the transcription of the nucleic acid constructs of the present invention, especially in a bacterial host cell, are the promoters obtained from the *E. coli* lac operon, *Streptomyces coelicolor* agarase gene (dagA), *Bacillus subtilis* levansucrase gene (sacB), *Bacillus licheniformis* alpha-amylase gene (amyL), *Bacillus stearothermophilus* maltogenic amylase gene (amyM), *Bacillus amyloliquefaciens* alpha-amylase gene (amyQ), *Bacillus licheniformis* penicillinase gene (penP), *Bacillus subtilis* xylA and xylB genes, and prokaryotic beta-lactamase gene (Villa-Kamaroff et al., 1978, *Proceedings of the National Academy of Sciences USA* 75: 3727-3731), as well as the tac promoter (DeBoer et al., 1983, *Proceedings of the National Academy of Sciences USA* 80: 21-25). Further promoters are described in "Useful proteins from recombinant bacteria" in *Scientific American* 242: 74-94 (1980); and in Sambrook et al., 1989, supra.

Examples of suitable promoters for directing the transcription of the nucleic acid constructs of the present invention in a filamentous fungal host cell are promoters obtained from the genes for *Aspergillus oryzae* TAKA amylase, *Rhizomucor miehei* aspartic proteinase, *Aspergillus niger* neutral alpha-amylase, *Aspergillus niger* acid stable alpha-amylase, *Aspergillus niger* or *Aspergillus awamori* glucoamylase (glaA), *Rhizomucor miehei* lipase, *Aspergillus oryzae* alkaline protease, *Aspergillus oryzae* triose phosphate isomerase, *Aspergillus nidulans* acetamidase, and *Fusarium oxysporum* trypsin-like protease (WO 96/00787), as well as the NA2-tpi promoter (a hybrid of the promoters from the genes for *Aspergillus niger* neutral alpha-amylase and *Aspergillus oryzae* triose phosphate isomerase), and mutant, truncated, and hybrid promoters thereof.

In a yeast host, useful promoters are obtained from the genes for *Saccharomyces cerevisiae* enolase (ENO-1), *Saccharomyces cerevisiae* galactokinase (GAL1), *Saccharomyces cerevisiae* alcohol dehydrogenase/glyceraldehyde-3-phosphate dehydrogenase (ADH2/GAP), and *Saccharomyces cerevisiae* 3-phosphoglycerate kinase. Other useful promoters for yeast host cells are described by Romanos et al., 1992, *Yeast* 8: 423-488.

The control sequence may also be a suitable transcription terminator sequence, a sequence recognized by a host cell to terminate transcription. The terminator sequence is operably linked to the 3' terminus of the nucleotide sequence encoding the polypeptide. Any terminator which is functional in the host cell of choice may be used in the present invention.

Preferred terminators for filamentous fungal host cells are obtained from the genes for *Aspergillus oryzae* TAKA amylase, *Aspergillus niger* glucoamylase, *Aspergillus nidulans* anthranilate synthase, *Aspergillus niger* alpha-glucosidase, and *Fusarium oxysporum* trypsin-like protease.

Preferred terminators for yeast host cells are obtained from the genes for *Saccharomyces cerevisiae* enolase, *Saccharomyces cerevisiae* cytochrome C (CYC1), and *Saccharomyces cerevisiae* glyceraldehyde-3-phosphate dehydrogenase. Other useful terminators for yeast host cells are described by Romanos et al., 1992, supra.

The control sequence may also be a suitable leader sequence, a nontranslated region of an mRNA which is important for translation by the host cell. The leader sequence is operably linked to the 5' terminus of the nucleotide sequence encoding the polypeptide. Any leader sequence that is functional in the host cell of choice may be used in the present invention.

Preferred leaders for filamentous fungal host cells are obtained from the genes for *Aspergillus oryzae* TAKA amylase and *Aspergillus nidulans* triose phosphate isomerase.

Suitable leaders for yeast host cells are obtained from the genes for *Saccharomyces cerevisiae* enolase (ENO-1), *Saccharomyces cerevisiae* 3-phosphoglycerate kinase, *Saccharomyces cerevisiae* alpha-factor, and *Saccharomyces cerevisiae* alcohol dehydrogenase/glyceraldehyde-3-phosphate dehydrogenase (ADH2/GAP).

The control sequence may also be a polyadenylation sequence, a sequence operably linked to the 3' terminus of the nucleotide sequence and which, when transcribed, is recognized by the host cell as a signal to add polyadenosine residues to transcribed mRNA. Any polyadenylation sequence which is functional in the host cell of choice may be used in the present invention.

Preferred polyadenylation sequences for filamentous fungal host cells are obtained from the genes for *Aspergillus oryzae* TAKA amylase, *Aspergillus niger* glucoamylase, *Aspergillus nidulans* anthranilate synthase, *Fusarium oxysporum* trypsin-like protease, and *Aspergillus niger* alpha-glucosidase.

Useful polyadenylation sequences for yeast host cells are described by Guo and Sherman, 1995, *Molecular Cellular Biology* 15: 5983-5990.

The control sequence may also be a signal peptide coding region that codes for an amino acid sequence linked to the amino terminus of a polypeptide and directs the encoded polypeptide into the cell's secretory pathway. The 5' end of the coding sequence of the nucleotide sequence may inherently contain a signal peptide coding region naturally linked in translation reading frame with the segment of the coding region which encodes the secreted polypeptide. Alternatively, the 5' end of the coding sequence may contain a signal peptide coding region which is foreign to the coding sequence. The foreign signal peptide coding region may be required where the coding sequence does not naturally contain a signal peptide coding region. Alternatively, the foreign signal peptide coding region may simply replace the natural signal peptide coding region in order to enhance secretion of the polypeptide. However, any signal peptide coding region which directs the expressed polypeptide into the secretory pathway of a host cell of choice may be used in the present invention.

Effective signal peptide coding regions for bacterial host cells are the signal peptide coding regions obtained from the genes for *Bacillus* NCIB 11837 maltogenic amylase, *Bacillus stearothermophilus* alpha-amylase, *Bacillus licheniformis* subtilisin, *Bacillus licheniformis* beta-lactamase, *Bacillus stearothermophilus* neutral proteases (nprT, nprS, nprM), and *Bacillus subtilis* prsA. Further signal peptides are described by Simonen and Palva, 1993, *Microbiological Reviews* 57: 109-137.

Effective signal peptide coding regions for filamentous fungal host cells are the signal peptide coding regions obtained from the genes for *Aspergillus oryzae* TAKA amylase, *Aspergillus niger* neutral amylase, *Aspergillus niger* glucoamylase, *Rhizomucor miehei* aspartic proteinase, *Humicola insolens* cellulase, and *Humicola lanuginosa* lipase.

Useful signal peptides for yeast host cells are obtained from the genes for *Saccharomyces cerevisiae* alpha-factor and *Saccharomyces cerevisiae* invertase. Other useful signal peptide coding regions are described by Romanos et al., 1992, supra.

The control sequence may also be a propeptide coding region that codes for an amino acid sequence positioned at the amino terminus of a polypeptide. The resultant polypeptide is known as a proenzyme or propolypeptide (or a zymogen in some cases). A propolypeptide is generally inactive and can be converted to a mature active polypeptide by catalytic or autocatalytic cleavage of the propeptide from the propolypeptide. The propeptide coding region may be obtained from the genes for *Bacillus subtilis* alkaline protease (aprE), *Bacillus subtilis* neutral protease (nprT), *Saccharomyces cerevisiae* alpha-factor, *Rhizomucor miehei* aspartic proteinase, and *Myceliophthora thermophila* laccase (WO 95/33836).

Where both signal peptide and propeptide regions are present at the amino terminus of a polypeptide, the propeptide region is positioned next to the amino terminus of a polypeptide and the signal peptide region is positioned next to the amino terminus of the propeptide region.

It may also be desirable to add regulatory sequences which allow the regulation of the expression of the polypeptide relative to the growth of the host cell. Examples of regulatory systems are those which cause the expression of the gene to be turned on or off in response to a chemical or physical stimulus, including the presence of a regulatory compound. Regulatory systems in prokaryotic systems include the lac, tac, and trp operator systems. In yeast, the ADH2 system or GAL1 system may be used. In filamentous fungi, the TAKA alpha-amylase promoter, *Aspergillus niger* glucoamylase promoter, and *Aspergillus oryzae* glucoamylase promoter may be used as regulatory sequences. Other examples of regulatory sequences are those which allow for gene amplification. In eukaryotic systems, these include the dihydrofolate reductase gene which is amplified in the presence of methotrexate, and the metallothionein genes which are amplified with heavy metals. In these cases, the nucleotide sequence encoding the polypeptide would be operably linked with the regulatory sequence.

The various nucleotide and control sequences described above may be joined together to produce a recombinant expression vector which may include one or more convenient restriction sites to allow for insertion or substitution of the nucleotide sequence encoding the polypeptide at such sites. Alternatively, the nucleotide sequence of the present invention may be expressed by inserting the nucleotide sequence or a nucleic acid construct comprising the sequence into an appropriate vector for expression. In creating the expression vector, the coding sequence is located in the vector so that the coding sequence is operably linked with the appropriate control sequences for expression.

The recombinant expression vector may be any vector (e.g., a plasmid or virus) which can be conveniently subjected to recombinant DNA procedures and can bring about the expression of the nucleotide sequence. The choice of the vector will typically depend on the compatibility of the vector with the host cell into which the vector is to be introduced. The vectors may be linear or closed circular plasmids.

The vector may be an autonomously replicating vector, i.e., a vector which exists as an extrachromosomal entity, the replication of which is independent of chromosomal replication, e.g., a plasmid, an extrachromosomal element, a minichromosome, or an artificial chromosome.

The vector may contain any means for assuring self-replication. Alternatively, the vector may be one which, when introduced into the host cell, is integrated into the genome and replicated together with the chromosome(s) into which it has been integrated. Furthermore, a single vector or plasmid or two or more vectors or plasmids which together contain the total DNA to be introduced into the genome of the host cell, or a transposon may be used.

The vectors of the present invention preferably contain one or more selectable markers which permit easy selection of transformed cells. A selectable marker is a gene the product of which provides for biocide or viral resistance, resistance to heavy metals, prototrophy to auxotrophs, and the like.

Suitable markers for yeast host cells are ADE2, HIS3, LEU2, LYS2, MET3, TRP1, and URA3. Selectable markers for use in a filamentous fungal host cell include, but are not limited to, amdS (acetamidase), argB (ornithine carbamoyltransferase), bar (phosphinothricin acetyltransferase), hygB (hygromycin phosphotransferase), niaD (nitrate reductase), pyrG (orotidine-5'-phosphate decarboxylase), sC (sulfate adenyltransferase), trpC (anthranilate synthase), as well as equivalents thereof.

Preferred for use in an *Aspergillus* cell are the amdS and pyrG genes of *Aspergillus nidulans* or *Aspergillus oryzae* and the bar gene of *Streptomyces hygroscopicus*.

The vectors of the present invention preferably contain an element(s) that permits stable integration of the vector into the host cell's genome or autonomous replication of the vector in the cell independent of the genome.

For integration into the host cell genome, the vector may rely on the nucleotide sequence encoding the polypeptide or any other element of the vector for stable integration of the vector into the genome by homologous or nonhomologous recombination. Alternatively, the vector may contain additional nucleotide sequences for directing integration by homologous recombination into the genome of the host cell. The additional nucleotide sequences enable the vector to be integrated into the host cell genome at a precise location(s) in the chromosome(s). To increase the likelihood of integration at a precise location, the integrational elements should preferably contain a sufficient number of nucleotides, such as 100 to 1,500 base pairs, preferably 400 to 1,500 base pairs, and most preferably 800 to 1,500 base pairs, which are highly homologous with the corresponding target sequence to enhance the probability of homologous recombination. The integrational elements may be any sequence that is homologous with the target sequence in the genome of the host cell. Furthermore, the integrational elements may be non-encoding or encoding nucleotide sequences. On the other hand, the vector may be integrated into the genome of the host cell by non-homologous recombination.

For autonomous replication, the vector may further comprise an origin of replication enabling the vector to replicate autonomously in the host cell in question. Examples of bacterial origins of replication are the origins of replication of plasmids pBR322, pUC19, pACYC177, and pACYC184 permitting replication in *E. coli*, and pUB110, pE194, pTA1060, and pAMβ1 permitting replication in *Bacillus*. Examples of origins of replication for use in a yeast host cell are the 2 micron origin of replication, ARS1, ARS4, the combination of ARS1 and CEN3, and the combination of ARS4 and CEN6. The origin of replication may be one having a mutation which makes its functioning temperature-sensitive in the host cell (see, e.g., Ehrlich, 1978, *Proceedings of the National Academy of Sciences USA* 75: 1433).

More than one copy of a nucleotide sequence of the present invention may be inserted into the host cell to increase production of the gene product. An increase in the copy number of the nucleotide sequence can be obtained by integrating at least one additional copy of the sequence into the host cell genome or by including an amplifiable selectable marker gene with the nucleotide sequence where cells containing amplified copies of the selectable marker gene, and thereby additional copies of the nucleotide sequence, can be selected for by cultivating the cells in the presence of the appropriate selectable agent.

The procedures used to ligate the elements described above to construct the recombinant expression vectors of the present invention are well known to one skilled in the art (see, e.g., Sambrook et al., 1989, supra).

Host Cells:

The present invention also relates to recombinant fermenting fungus, or a host cell comprising the nucleic acid construct of the invention, which are advantageously used in the recombinant production of the polypeptides on site. A vector comprising a nucleotide sequence of the present invention is introduced into a host cell so that the vector is maintained as a chromosomal integrant or as a self-replicating extra-chromosomal vector as described earlier.

The host cell is a fungal cell. "Fungi" as used herein includes the phyla Ascomycota, Basidiomycota, Chytridiomycota, and Zygomycota (as defined by Hawksworth et al., In, *Ainsworth and Bisby's Dictionary of The Fungi*, 8th edition, 1995, CAB International, University Press, Cambridge, UK) as well as the Oomycota (as cited in Hawksworth et al., 1995, supra, page 171) and all mitosporic fungi (Hawksworth et al., 1995, supra).

In a more preferred embodiment, the fungal host cell is a filamentous fungal cell. "Filamentous fungi" include all filamentous forms of the subdivision Eumycota and Oomycota (as defined by Hawksworth et al., 1995, supra). The filamentous fungi are characterized by a mycelial wall composed of chitin, cellulose, glucan, chitosan, mannan, and other complex polysaccharides. Vegetative growth is by hyphal elongation and carbon catabolism is obligately aerobic.

In a preferred embodiment, the filamentous fungal host cell is a cell of a thermophilic or thermo tolerant fungi such as a species within Ascomycotina, Basidiomycotina, Zygomycota or Chytridiomycota, in particular a species within the group consisting of *Chaetomium, Thermoascus, Malbranchea,* or *Thielavia,* such as *Thielavia terrestris,* or *Trichophaea.* Even more preferably the host cell is a strain of *Trichophaea saccata* or *Humicola,* such as *H. insolens.*

Fungal cells may be transformed by a process involving protoplast formation, transformation of the protoplasts, and regeneration of the cell wall in a manner known per se. Suitable procedures for transformation of *Aspergillus* host cells are described in EP 0238023 and Yelton et al., 1984, *Proceedings of the National Academy of Sciences USA* 81: 1470-1474. Suitable methods for transforming *Fusarium* species are described by Malardier et al., 1989, *Gene* 78: 147-156 and WO 96/00787. Yeast may be transformed using the procedures described by Becker and Guarente, In Abelson, J. N. and Simon, M. I., editors, *Guide to Yeast Genetics and Molecular Biology, Methods in Enzymology*, Volume 194, pp 182-187, Academic Press, Inc., New York; Ito et al., 1983, *Journal of Bacteriology* 153: 163; and Hinnen et al., 1978, *Proceedings of the National Academy of Sciences USA* 75: 1920.

Expression of the Enzymes in Plants

A DNA sequence encoding a polypeptide of interest, such as a hybrid enzyme or a variant of a wild type enzyme or a hybrid of the present invention, may be transformed and expressed in transgenic plants as described below.

The transgenic plant can be dicotyledonous or monocotyledonous, for short a dicot or a monocot. Examples of monocot plants are grasses, such as meadow grass (blue grass, Poa), forage grass such as *Festuca, Lolium,* temperate grass, such as *Agrostis,* and cereals, e.g., wheat, oats, rye, barley, rice, sorghum and maize (corn).

Examples of dicot plants are tobacco, legumes, such as lupins, potato, sugar beet, pea, bean and soybean, and cruciferous plants (family Brassicaceae), such as cauliflower, oil seed rape and the closely related model organism *Arabidopsis thaliana.*

Examples of plant parts are stem, callus, leaves, root, fruits, seeds, and tubers as well as the individual tissues comprising these parts, e.g., epidermis, mesophyll, parenchyme, vascular tissues, meristems. In the present context, also specific plant cell compartments, such as chloroplast, apoplast, mitochondria, vacuole, peroxisomes and cytoplasm are considered to be a plant part. Furthermore, any plant cell, whatever the tissue origin, is considered to be a plant part. Likewise, plant parts such as specific tissues and cells isolated to facilitate the utilisation of the invention are also considered plant parts, e.g., embryos, endosperms, aleurone and seeds coats.

Also included within the scope of the invention are the progeny of such plants, plant parts and plant cells.

The transgenic plant or plant cell expressing the polypeptide of interest may be constructed in accordance with methods known in the art. In short the plant or plant cell is constructed by incorporating one or more expression constructs encoding the polypeptide of interest into the plant host genome and propagating the resulting modified plant or plant cell into a transgenic plant or plant cell.

Conveniently, the expression construct is a DNA construct which comprises a gene encoding the polypeptide of interest in operable association with appropriate regulatory sequences required for expression of the gene in the plant or plant part of choice. Furthermore, the expression construct may comprise a selectable marker useful for identifying host cells into which the expression construct has been integrated and DNA sequences necessary for introduction of the construct into the plant in question (the latter depends on the DNA introduction method to be used).

The choice of regulatory sequences, such as promoter and terminator sequences and optionally signal or transit sequences is determined, e.g., on the basis of when, where and how the enzyme is desired to be expressed. For instance, the expression of the gene encoding the enzyme of the invention may be constitutive or inducible, or may be developmental, stage or tissue specific, and the gene product may be targeted to a specific cell compartment, tissue or plant part such as seeds or leaves. Regulatory sequences are, e.g., described by Tague et al., 1988, *Plant Phys.* 86: 506.

For constitutive expression the 35S-CaMV, the maize ubiquitin 1 and the rice actin 1 promoter may be used (Franck et al., 1980, *Cell* 21: 285-294, Christensen A H, Sharrock R A and Quail 1992. Maize polyubiquitin genes: structure, thermal perturbation of expression and transcript splicing, and promoter activity following transfer to protoplasts by electroporation. *Plant Mol. Biol.* 18: 675-689; Zhang et al., 1991, Analysis of rice Act1 5' region activity in transgenic rice plants. *Plant Cell* 3: 1155-1165). Organ-specific promoters may, e.g., be a promoter from storage sink tissues such as seeds, potato tubers, and fruits (Edwards & Coruzzi, 1990, *Annu. Rev. Genet.* 24: 275-303), or from metabolic sink tissues such as meristems (Ito et al., 1994, *Plant Mol. Biol.* 24: 863-878), a seed specific promoter such as the glutelin, prolamin, globulin or albumin promoter from rice (Wu et al., 1998, *Plant and Cell Physiology* 39(8): 885-889), a *Vicia faba* promoter from the legumin B4 and the unknown seed protein gene from *Vicia faba* described by Conrad et al., 1998, *Jour-*

*nal of Plant Physiology* 152(6): 708-711, a promoter from a seed oil body protein (Chen et al., 1998, *Plant and Cell Physiology* 39(9): 935-941, the storage protein napA promoter from *Brassica napus*, or any other seed specific promoter known in the art, e.g., as described in WO 91/14772. Furthermore, the promoter may be a leaf specific promoter such as the rbcs promoter from rice or tomato (Kyozuka et al., 1993, *Plant Physiology* 102(3): 991-1000, the chlorella virus adenine methyltransferase gene promoter (Mitra et al., 1994, *Plant Molecular Biology* 26(1): 85-93, or the aldP gene promoter from rice (Kagaya et al., 1995, *Molecular and General Genetics* 248(6): 668-674, or a wound inducible promoter such as the potato pin2 promoter (Xu et al., 1993, *Plant Molecular Biology* 22(4): 573-588). Likewise, the promoter may inducible by abiotic treatments such as temperature, drought or alterations in salinity or induced by exogenously applied substances that activate the promoter, e.g., ethanol, oestrogens, plant hormones like ethylene, abscisic acid and gibberellic acid and heavy metals.

A promoter enhancer element may be used to achieve higher expression of the enzyme in the plant. For instance, the promoter enhancer element may be an intron which is placed between the promoter and the nucleotide sequence encoding the enzyme. For instance, Xu et al. op cit disclose the use of the first intron of the rice actin 1 gene to enhance expression.

The selectable marker gene and any other parts of the expression construct may be chosen from those available in the art.

The DNA construct is incorporated into the plant genome according to conventional techniques known in the art, including *Agrobacterium*-mediated transformation, virus-mediated transformation, micro injection, particle bombardment, biolistic transformation, and electroporation (Gasser et al., *Science* 244: 1293; Potrykus, 1990, *Bio/Techn.* 8: 535; Shimamoto et al., 1989, *Nature* 338: 274).

Presently, *Agrobacterium tumefaciens* mediated gene transfer is the method of choice for generating transgenic dicots (for review Hooykas & Schilperoort, 1992, *Plant Mol. Biol.* 19: 15-38), and can also be used for transforming monocots, although other transformation methods often are used for these plants. Presently, the method of choice for generating transgenic monocots supplementing the *Agrobacterium* approach is particle bombardment (microscopic gold or tungsten particles coated with the transforming DNA) of embryonic calli or developing embryos (Christou, 1992, *Plant J.* 2: 275-281; Shimamoto, 1994, *Curr. Opin. Biotechnol.* 5: 158-162; Vasil et al., 1992, *Bio/Technology* 10: 667-674). An alternative method for transformation of monocots is based on protoplast transformation as described by Omirulleh et al., 1993, *Plant Molecular Biology* 21(3): 415-428.

Following transformation, the transformants having incorporated the expression construct are selected and regenerated into whole plants according to methods well-known in the art. Often the transformation procedure is designed for the selective elimination of selection genes either during regeneration or in the following generations by using, e.g., co-transformation with two separate T-DNA constructs or site specific excision of the selection gene by a specific recombinase.

Starch Processing

The polypeptide of the first, second and/or third aspect may be used in a process for liquefying starch, wherein a gelatinized or granular starch substrate is treated in aqueous medium with the hybrid enzyme. The polypeptide of the first, second and/or third aspect may also be used in a process for saccharification of a liquefied starch substrate. A preferred use is in a fermentation process wherein a starch substrate is liquefied and/or saccharified in the presence of the polypeptide of the first, second and/or third aspect to produce glucose and/or maltose suitable for conversion into a fermentation product by a fermenting organism, preferably a yeast. Such fermentation processes include a process for producing ethanol for fuel or drinking ethanol (portable alcohol), a process for producing a beverage, a process for producing desired organic compounds, such as citric acid, itaconic acid, lactic acid, gluconic acid, sodium gluconate, calcium gluconate, potassium gluconate, glucono delta lactone, or sodium erythorbate; ketones; amino acids, such as glutamic acid (sodium monoglutaminate), but also more complex compounds such as antibiotics, such as penicillin, tetracyclin; enzymes; vitamins, such as riboflavin, B12, beta-carotene; hormones, which are difficult to produce synthetically.

The starch to be processed may be a highly refined starch quality, preferably at least 90%, at least 95%, at least 97% or at least 99.5% pure or it may be a more crude starch containing material comprising milled whole grain including non-starch fractions such as germ residues and fibres. The raw material, such as whole grain, is milled in order to open up the structure and allowing for further processing. Two milling processes are preferred according to the invention: wet and dry milling. Also corn grits, and preferably milled corn grits may be applied.

Dry milled grain will in addition to starch comprise significant amounts of non-starch carbohydrate compounds. When such a heterogeneous material is processed by jet cooking often only a partial gelatinization of the starch is achieved. As the polypeptides of the invention have a high activity towards ungelatinized starch the polypeptides are advantageously applied in a process comprising liquefaction and/or saccharification jet cooked dry milled starch.

Furthermore, due to the superior hydrolysis activity of the polypeptide of the first aspect the need for glucoamylase during the saccharification step is greatly reduced. This allows saccharification to be performed at very low levels of glucoamylase activity and preferably glucoamylase activity is either absent or if present, then present in an amount of no more than or even less than 0.5 AGU/g DS, more preferably no more than or even less than 0.4 AGU/g DS, even more preferably no more than or even less than 0.3 AGU/g DS, and most preferably less than 0.1 AGU, such as no more than or even less than 0.05 AGU/g DS of starch substrate. Expressed in mg enzyme protein the enzyme having glucoamylase activity is either absent or present in an in an amount of no more than or even less than 0.5 mg EP/g DS, more preferably no more than or even less than 0.4 mg EP/g DS, even more preferably no more than or even less than 0.3 mg EP/g DS, and most preferably no more than or even less than 0.1 mg EP/g DS, such as no more than or even less than 0.05 mg EP/g DS or no more than or even less than 0.02 mg EP/g DS of starch substrate. The glucoamylase may preferably be derived from a strain within *Aspergillus* sp., *Talaromyces* sp., *Pachykytospora* sp. or *Trametes* sp., more preferably from *Aspergillus niger, Talaromyces emersonii, Trametes cingulata* or *Pachykytospora papyracea.*

Again due to the superior hydrolysis activity of the polypeptide of the first aspect the need for alpha-amylase in the liquefaction and/or saccharification step is greatly reduced. Expressed in mg enzyme protein the polypeptide of the first aspect may be dosed in amounts of no more than or even less than 0.5 mg EP/g DS, more preferably no more than or even less than 0.4 mg EP/g DS, even more preferably no more than or even less than 0.3 mg EP/g DS, and most preferably no more than or even less than 0.1 mg EP/g DS, such as no more than or even less than 0.05 mg EP/g DS or no more than or even less than 0.02 mg EP/g DS of starch substrate. The polypeptide of the first aspect may be dosed in amounts of 0.05 to 10.0 AFAU/g DS, preferably 0.1 to 5.0 AFAU/g DS, more preferably from 0.25 to 2.5 AFAU/g DS starch. The process may comprise; a) contacting a starch substrate with a polypeptide comprising a catalytic module having alpha-amylase activity and a carbohydrate-binding module, e.g., the polypeptide of the first aspect; b) incubating said starch substrate with said polypeptide for a time and at a temperature sufficient to achieve conversion of at least 90%, or at least 92%, at least 94%, at least 95%, at least 96%, at least 97%, at least 98%, at least 99%, at least 99.5% w/w of said starch substrate into fermentable sugars; c) fermenting to produce a fermentation product, d) optionally recovering the fermentation product. During the process steps b) and/or c) an enzyme having glucoamylase activity is either absent or present in an amount from 0.001 to 2.0 AGU/g DS, from 0.01 to 1.5 AGU/g DS, from 0.05 to 1,0 AGU/g DS, from 0.01 to 0.5 AGU/g DS. Preferably the enzyme having glucoamylase activity is either absent or present in an in an amount of no more than or even less than 0.5 AGU/g DS, more preferably no more than or even less than 0.4 AGU/g DS, even more preferably no more than or even less than 0.3 AGU/g DS, and most preferably no more than or even less than 0.1 AGU, such as no more than or even less than 0.05 AGU/g DS of starch substrate. Expressed in mg enzyme protein the enzyme having glucoamylase activity is either absent or present in an in an amount of no more than or even less than 0.5 mg EP/g DS, more preferably no more than or even less than 0.4 mg EP/g DS, even more preferably no more than or even less than 0.3 mg EP/g DS, and most preferably no more than or even less than 0.1 mg EP/g DS, such as no more than or even less than 0.05 mg EP/g DS or no more than or even less than 0.02 mg EP/g DS of starch substrate. In the process step a, b, c, and/or d may be performed separately or simultaneously.

In another aspect the process may comprise; a) contacting a starch substrate with a yeast cell transformed to express a polypeptide comprising a catalytic module having alpha-amylase activity and a carbohydrate-binding module, e.g., the polypeptide of the first and/or second aspect; b) incubating said starch substrate with said yeast for a time and at a temperature sufficient to achieve conversion of at least 90% w/w of said starch substrate into fermentable sugars; c) fermenting to produce ethanol; d) optionally recovering ethanol. The steps a, b, and c may performed separately or simultaneously.

In yet another aspect the process comprising hydrolysis of a slurry of gelatinized or granular starch, in particular hydrolysis of granular starch into a soluble starch hydrolysate at a temperature below the initial gelatinization temperature of said granular starch. In addition to being contacted with a polypeptide comprising a catalytic module having alpha-amylase activity and a carbohydrate-binding module, e.g., the polypeptide of the first aspect, the starch may be contacted with an enzyme selected from the group consisting of; a fungal alpha-amylase (EC 3.2.1.1), a beta-amylase (E.C. 3.2.1.2), and a glucoamylase (E.C.3.2.1.3). In an embodiment further a bacterial alpha-amylase or a debranching enzyme, such as an isoamylase (E.C. 3.2.1.68) or a pullulanases (E.C. 3.2.1.41) may be added. In the context of the present invention a bacterial alpha-amylase is an alpha-amylase as defined in WO 99/19467 on page 3, line 18 to page 6, line 27.

In an embodiment the process is conducted at a temperature below the initial gelatinization temperature. Preferably the temperature at which the processes are conducted is at least 30° C., at least 31° C., at least 32° C., at least 33° C., at least 34° C., at least 35° C., at least 36° C., at least 37° C., at least 38° C., at least 39° C., at least 40° C., at least 41° C., at least 42° C., at least 43° C., at least 44° C., at least 45° C., at least 46° C., at least 47° C., at least 48° C., at least 49° C., at least 50° C., at least 51° C., at least 52° C., at least 53° C., at least 54° C., at least 55° C., at least 56° C., at least 57° C., at least 58° C., at least 59° C., or preferably at least 60° C. The pH at which the process is conducted may in be in the range of 3.0 to 7.0, preferably from 3.5 to 6.0, or more preferably from 4.0-5.0. In a preferred embodiment the process comprises fermentation, e.g. with a yeast to produce ethanol, e.g., at a temperature around 32° C., such as from 30 to 35° C.

In another preferred embodiment the process comprises simultaneous saccharification and fermentation, e.g. with a yeast to produce ethanol, or another suitable fermentation organism to produce a desired organic compound, such as at a temperature from 30 to 35° C., e.g., at around 32° C.

In the above fermentation processes the ethanol content reaches at least 7%, at least 8%, at least 9%, at least 10%, at least 11%, at least 12%, at least 13%, at least 14%, at least 15% such as at least 16% ethanol.

The starch slurry to be used in any of the above aspects may have 20-55% dry solids granular starch, preferably 25-40% dry solids granular starch, more preferably 30-35% dry solids granular starch. After being contacted with the polypeptide comprising a catalytic module having alpha-amylase activity and a carbohydrate-binding module, e.g., the polypeptide of the first aspect at least 85%, at least 86%, at least 87%, at least 88%, at least 89%, at least 90%, at least 91%, at least 92%, at least 93%, at least 94%, at least 95%, at least 96%, at least 97%, at least 98%, or preferably at least 99% of the dry solids of the granular starch is converted into a soluble starch hydrolysate.

In another preferred embodiment the polypeptide comprising a catalytic module having alpha-amylase activity and a carbohydrate-binding module, e.g., the polypeptide of the first aspect, is used in a process for liquefaction, saccharification of a gelatinized starch, e.g., but not limited to gelatinization by jet cooking. The process may comprise fermentation to produce a fermentation product, e.g., ethanol. Such a process for producing ethanol from starch-containing material by fermentation comprises: (i) liquefying said starch-containing material with a polypeptide comprising a catalytic module having alpha-amylase activity and a carbohydrate-binding module, e.g., the polypeptide of the first aspect; (ii) saccharifying the liquefied mash obtained; (iii) fermenting the material obtained in step (ii) in the presence of a fermenting organism. Optionally the process further comprises recovery of the ethanol. The saccharification and fermentation may be carried out as a simultaneous saccharification and fermentation process (SSF process). During the fermentation the ethanol content reaches at least 7%, at least 8%, at least 9%, at least 10% such as at least 11%, at least 12%, at least 13%, at least 14%, at least 15% such as at least 16% ethanol.

The starch to be processed in the processes of the above aspects may in particular be obtained from tubers, roots, stems, legumes, cereals or whole grain. More specifically the granular starch may be obtained from corns, cobs, wheat, barley, rye, milo, sago, cassava, tapioca, sorghum, rice, peas, bean, banana or potatoes. Specially contemplated are both waxy and non-waxy types of corn and barley.

The invention also relates to a composition comprising the polypeptide of the first and/or second aspect. In a particularly preferred embodiment the composition comprises a polypeptide of the first aspect which polypeptide is selected from the group consisting of V001, V002, V003, V004, V005, V006, V007, V008, V009, V010, V011, V012, V013, V014, V015, V016, V017, V018, V019, V021, V022, V023, V024, V025, V026, V027, V028, V029, V030, V031, V032, V033, V034, V035, V036, V037, V038, V039, V040, V041, V042, V043, V047, V048, V049, V050, V051, V052, V054, V055, V057, V059, V060, V061, V063, V064, V065, V066, V067, V068 and V069. The composition may further comprise an enzyme selected from the group comprising of; a fungal alpha-amylase (EC 3.2.1.1), a beta-amylase (E.C. 3.2.1.2), a glucoamylase (E.C.3.2.1.3) and a pullulanases (E.C. 3.2.1.41). The glucoamylase may preferably be derived from a strain of *Aspergillus* sp., such as *Aspergillus niger*, or from a strain of *Talaromyces* sp. and in particular derived from *Talaromyces leycettanus* such as the glucoamylase disclosed in U.S. Pat. No. Re. 32,153, *Talaromyces duponti* and/or *Talaromyces thermopiles* such as the glucoamylases disclosed in U.S. Pat. No. 4,587,215 and more preferably derived from *Talaromyces emersonii*. Most preferably the glucoamylase is derived from *Talaromyces emersonii* strain CBS 793.97 and/or having the sequence disclosed as SEQ ID NO: 7 in WO 99/28448. Further preferred is a glucoamylase which has an amino acid sequence having at least 50%, at least 60%, at least 70%, at least 80%, at least 90% or even at least 95% homology to the aforementioned amino acid sequence. A commercial *Talaromyces* glucoamylase preparation is supplied by Novozymes A/S as Spirizyme Fuel.

Also preferred for a composition comprising the polypeptide of the first and/or second aspect and a glucoamylase are polypeptides having glucoamylase activity which are derived from a strain of the genus *Trametes*, preferably *Trametes cingulata*. Further preferred is polypeptides having glucoamylase activity and having at least 50%, at least 60%, at least 70%, at least 80%, at least 90% or even at least 95% homology with amino acids for mature polypeptide amino acids 1 to 575 of SEQ ID NO: 5 in U.S. Patent Application No. 60/650,612.

Also preferred for a composition comprising the polypeptide of the first and/or second aspect and a glucoamylase are polypeptides having glucoamylase activity which are derived from a strain of the genus *Pachykytospora*, preferably *Pachykytospora papyracea* or the *E. coli* strain deposited at DSMZ and given the no. DSM 17105. Further preferred are polypeptides having glucoamylase activity and having at least 50%, at least 60%, at least 70%, at least 80%, at least 90% or even at least 95% homology with amino acids for mature polypeptide amino acids 1 to 556 of SEQ ID NO: 2 in U.S. Patent Application No. 60/650,612.

The composition described above may be used for liquefying and/or saccharifying a gelatinized or a granular starch, as well as a partly gelatinized starch. A partly gelatinized starch is a starch which to some extent is gelatinized, i.e., wherein part of the starch has irreversibly swelled and gelatininized and part of the starch is still present in a granular state.

The composition described above may preferably comprise acid alpha-amylase present in an amount of 0.01 to 10 AFAU/g DS, preferably 0.1 to 5 AFAU/g DS, more preferably 0.5 to 3 AFAU/AGU, and most preferably 0.3 to 2 AFAU/g DS. The composition may be applied in any of the starch processes described above.

Materials and Methods
Determination of Acid Alpha-Amylase Activity

When used according to the present invention the activity of any acid alpha-amylase may be measured in AFAU (Acid Fungal Alpha-amylase Units), which are determined relative to an enzyme standard. 1 AFAU is defined as the amount of enzyme which degrades 5.260 mg starch dry matter per hour under the below mentioned standard conditions.

Acid alpha-amylase, i.e., acid stable alpha-amylase, an endo-alpha-amylase (1,4-alpha-D-glucan-glucano-hydrolase, E.C. 3.2.1.1) hydrolyzes alpha-1,4-glucosidic bonds in the inner regions of the starch molecule to form dextrins and oligosaccharides with different chain lengths. The intensity of color formed with iodine is directly proportional to the concentration of starch. Amylase activity is determined using reverse colorimetry as a reduction in the concentration of starch under the specified analytical conditions.

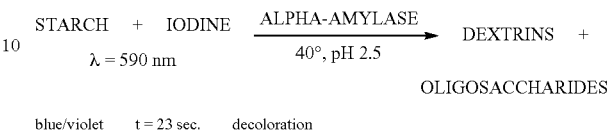

$$\text{STARCH} + \text{IODINE} \xrightarrow[40°, \text{pH } 2.5]{\text{ALPHA-AMYLASE}} \text{DEXTRINS} + \text{OLIGOSACCHARIDES}$$

$\lambda = 590$ nm blue/violet   t = 23 sec.   decoloration

Standard Conditions/Reaction Conditions:
Substrate: Soluble starch, approx. 0.17 g/L
Buffer: Citrate, approx. 0.03 M
Iodine (I2): 0.03 g/L
$CaCl_2$: 1.85 mM
pH: 2.50±0.05
Incubation temperature: 40° C.
Reaction time: 23 seconds
Wavelength: 590 nm
Enzyme concentration: 0.025 AFAU/mL
Enzyme working range: 0.01-0.04 AFAU/mL A folder EB-SM-0259.02/01 describing this analytical method in more detail is available upon request to Novozymes A/S, Denmark, which folder is hereby included by reference.

Glucoamylase Activity

Glucoamylase activity may be measured in AmyloGlucosidase Units (AGU). The AGU is defined as the amount of enzyme, which hydrolyzes 1 micromole maltose per minute under the standard conditions 37° C., pH 4.3, substrate: maltose 23.2 mM, buffer: acetate 0.1 M, reaction time 5 minutes.

An autoanalyzer system may be used. Mutarotase is added to the glucose dehydrogenase reagent so that any alpha-D-glucose present is turned into beta-D-glucose. Glucose dehydrogenase reacts specifically with beta-D-glucose in the reaction mentioned above, forming NADH which is determined using a photometer at 340 nm as a measure of the original glucose concentration.

AMG Incubation:
Substrate: maltose 23.2 mM
Buffer: acetate 0.1 M
Ph: 4.30±0.05
Incubation 37° C.±1
temperature:
Reaction time: 5 minutes
Enzyme working range: 0.5-4.0 AGU/mL
Color Reaction:
GlucDH: 430 U/L
Mutarotase: 9 U/L
NAD: 0.21 mM
Buffer: phosphate 0.12 M; 0.15 M NaCl
pH: 7.60±0.05
Incubation temperature: 37° C.±1
Reaction time: 5 minutes
Wavelength: 340 nm A folder (EB-SM-0131.02/01) describing this analytical method in more detail is available on request from Novozymes A/S, Denmark, which folder is hereby included by reference.

Strains and Plasmids

*E. coli* DH12S (available from Gibco BRL) was used for yeast plasmid rescue.

pLA1 is a *S. cerevisiae* and *E. coli* shuttle vector under the control of TPI promoter, constructed from pJC039 described in WO 01/92502. The acid *Aspergillus niger* alpha-amylase signal sequence, the acid *Aspergillus niger* alpha-amylase gene (SEQ ID NO: 1) and the partial *Athelia rolfsii* glucoamylase gene sequence comprising the linker (SEQ ID NO: 67) and the CBM (SEQ ID NO: 91) has been inserted. The full sequence of the plasmid is given in SEQ ID NO: 103. The alpha-amylase gene is the sequence from 5029 to 6468, the linker is the sequence from 6469 to 6501 and the CBM is the sequence from 6502 to 6795. The vector was used for alpha-amylase CBM hybrid construction.

*Saccharomyces cerevisiae* YNG318: MATa Dpep4[cir+] ura3-52, leu2-D2, his 4-539 was used for alpha-amylase variants expression. It is described in *J. Biol. Chem.* 272(15): 9720-9727 (1997).

Media and Substrates

10× Basal Solution:

Yeast nitrogen base w/o amino acids (DIFCO) 66.8 g/l, succinate 100 g/l, NaOH 60 g/l.

SC-Glucose:

20% glucose (i.e., a final concentration of 2%=2 g/100 ml)) 100 ml/l, 5% threonine 4 ml/l, 1% tryptophan 10 ml/l, 20% casamino acids 25 ml/l, 10× basal solution 100 ml/l. The solution is sterilized using a filter of a pore size of 0.20 micrometer. Agar and H$_2$O (approx. 761 ml) is autoclaved together, and the separately sterilized SC-glucose solution added to the agar solution.

YPD:

Bacto peptone 20 g/l, yeast extract 10 g/l, 20% glucose 100 ml/l.

PEG/LiAc Solution:

40% PEG4000 50 ml, 5 M Lithium Acetate 1 ml

DNA Manipulations

Unless otherwise stated, DNA manipulations and transformations were performed using standard methods of molecular biology as described in Sambrook et al., 1989, Molecular Cloning: A Laboratory Manual, Cold Spring Harbor Lab, Cold Spring Harbor, N.Y.; Ausubel, F. M. et al. (eds.) "Current Protocols in Molecular Biology", John Wiley and Sons, 1995; Harwood, C. R. and Cutting, S. M. (eds.).

Yeast Transformation

Yeast transformation was carried out by lithium acetate method. Mix 0.5 microL of vector (digested by restriction endnucleases) and 1 microL of PCR fragments. Thaw YNG318 competent cells on ice. Mix 100 microL of the cells, the DNA mixture and 10 microL of carrier DNA (Clontech) in 12 ml polypropylene tubes (Falcon 2059). Add 0.6 ml PEG/LiAc solution and mix gently. Incubate for 30 min at 30° C., and 200 rpm. Incubate for 30 min at 42° C. (heat shock). Transfer to an eppendorf tube and centrifuge for 5 sec. Remove the supernatant and resolve in 3 ml of YPD. Incubate the cell suspension for 45 min at 200 rpm at 30° C. Pour the suspension to SC-glucose plates and incubate 30° C. for 3 days to make colonies. Yeast total DNA was extracted by the Robzyk and Kassir's method described in *Nucleic Acids Research* 20(14): 3790 (1992).

DNA Sequencing

*E. coli* transformation for DNA sequencing was carried out by electroporation (BIO-RAD Gene Pulser). DNA Plasmids were prepared by alkaline method (Molecular Cloning, Cold Spring Harbor) or with the Qiagen® Plasmid Kit. DNA fragments were recovered from agarose gel by the Qiagen gel extraction Kit. PCR was performed using a PTC-200 DNA Engine. The ABI PRISM™ 310 Genetic Analyzer was used for determination of all DNA sequences.

TABLE 2

Amino acid (AA) and DNA sequences numbers of catalytic domains (CD), linkers, carbohydrate binding modules (CBM), plasmids, and primers applied. AA is alpha-amylase, GA is glucoamylase.

| Type | CODE | Sequence origin | SEQ ID | |
|------|------|-----------------|--------|---|
| CD | C001 | *Aspergillus niger* AA | SEQ ID NO: 1 | dna |
| CD | C001 | *Aspergillus niger* AA | SEQ ID NO: 2 | aa |
| CD | C002 | *Aspergillus oryzae* AA Fungamyl | SEQ ID NO: 3 | dna |
| CD | C002 | *Aspergillus oryzae* AA Fungamyl | SEQ ID NO: 4 | Aa |
| CD | C003 | *Aspergillus oryzae* AA Fungamyl variant | SEQ ID NO: 5 | Dna |
| CD | C003 | *Aspergillus oryzae* AA Fungamyl variant | SEQ ID NO: 6 | Aa |
| CD | C004 | *Trichophaea saccata* AA | SEQ ID NO: 7 | Dna |
| CD | C004 | *Trichophaea saccata* AA | SEQ ID NO: 8 | Aa |
| CD | C005 | *Subulispora provurvata* AA | SEQ ID NO: 9 | Dna |
| CD | C005 | *Subulispora procurvata* AA | SEQ ID NO: 10 | Aa |
| CD | C006 | *Valsaria rubricosa* AA | SEQ ID NO: 11 | Dna |
| CD | C006 | *Valsaria rubricosa* AA | SEQ ID NO: 12 | Aa |
| CD | C007 | *Thermomyces lanuginosus* AA | SEQ ID NO: 13 | Dna |
| CD | C007 | *Thermomyces lanuginosus* AA | SEQ ID NO: 14 | Aa |
| CD | C008 | *Acremonium* sp. AA | SEQ ID NO: 15 | Dna |
| CD | C008 | *Acremonium* sp. AA | SEQ ID NO: 16 | Aa |
| CD | C009 | *Malbranchea* sp. AA | SEQ ID NO: 17 | dna |
| CD | C009 | *Malbranchea* sp. AA | SEQ ID NO: 18 | Aa |
| CD | C010 | *Rhizomucor pusillus* AA | SEQ ID NO: 19 | Dna |
| CD | C010 | *Rhizomucor pusillus* AA | SEQ ID NO: 20 | Aa |
| CD | C011 | *Dichotomocladium hesseftinei* AA | SEQ ID NO: 21 | dna |
| CD | C011 | *Dichotomocladium hesseftinei* AA | SEQ ID NO: 22 | Aa |
| CD | C012 | *Meripilus giganteus* AA | SEQ ID NO: 23 | dna |
| CD | C012 | *Meripilus giganteus* AA | SEQ ID NO: 24 | Aa |
| CD | C013 | *Stereum* sp. AA | SEQ ID NO: 25 | dna |
| CD | C013 | *Stereum* sp. AA | SEQ ID NO: 26 | aa |
| CD | C014 | *Trametes* sp. | SEQ ID NO: 27 | dna |
| CD | C014 | *Trametes* sp. | SEQ ID NO: 28 | aa |
| CD | C015 | *Coriolus censors* AA | SEQ ID NO: 29 | dna |
| CD | C015 | *Coriolus censors* AA | SEQ ID NO: 30 | aa |
| CD | C016 | *Dinemasporium* sp. AA | SEQ ID NO: 31 | dna |
| CD | C016 | *Dinemasporium* sp. AA | SEQ ID NO: 32 | aa |
| CD | C017 | *Cryptosporiopsis* sp. AA | SEQ ID NO: 33 | dna |

TABLE 2-continued

Amino acid (AA) and DNA sequences numbers of catalytic domains (CD), linkers, carbohydrate binding modules (CBM), plasmids, and primers applied. AA is alpha-amylase, GA is glucoamylase.

| Type | CODE | Sequence origin | SEQ ID | |
|---|---|---|---|---|
| CD | C017 | *Cryptosporiopsis* sp. AA | SEQ ID NO: 34 | aa |
| CD | C018 | *Coniochaeta* sp. AA | SEQ ID NO: 35 | dna |
| CD | C018 | *Coniochaeta* sp. AA | SEQ ID NO: 36 | aa |
| CD | C020 | *Diplodia* sp. AA | SEQ ID NO: 37 | Dna |
| CD | C020 | *Diplodia* sp. AA | SEQ ID NO: 38 | Aa |
| CD | C021 | *Nectria* sp. AA | SEQ ID NO: 39 | Dna |
| CD | C021 | *Nectria* sp. AA | SEQ ID NO: 40 | Aa |
| CD | C022 | *Gliocladium* sp. AA | SEQ ID NO: 41 | Dna |
| CD | C022 | *Gliocladium* sp. AA | SEQ ID NO: 42 | Aa |
| CD | C023 | *Streptomyces thermocyaneoviolaceus* AA | SEQ ID NO: 43 | Dna |
| CD | C023 | *Streptomyces thermocyaneoviolaceus* AA | SEQ ID NO: 44 | Aa |
| Linker | C024 | *Pachykytospora papayracea* GA | SEQ ID NO: 45 | Dna |
| Linker | C024 | *Pachykytospora papayracea* GA | SEQ ID NO: 46 | Aa |
| Linker | C025 | *Trametes cingulata* GA | SEQ ID NO: 47 | Dna |
| Linker | C025 | *Trametes cingulata* GA | SEQ ID NO: 48 | Aa |
| Linker | C026 | *Leucopaxillus gigantus* GA | SEQ ID NO: 49 | Dna |
| Linker | C026 | *Leucopaxillus gigantus* GA | SEQ ID NO: 50 | Aa |
| Linker + CBM | C027 | *Trichophaea saccata* AA | SEQ ID NO: 51 | Dna |
| Linker + CBM | C027 | *Trichophaea saccata* AA | SEQ ID NO: 52 | Aa |
| Linker | C028 | *Sublispora provurvata* AA | SEQ ID NO: 53 | dna |
| Linker | C028 | *Sublispora provurvata* AA | SEQ ID NO: 54 | aa |
| Linker | C029 | *Valsaria rubricosa* AA | SEQ ID NO: 55 | dna |
| Linker | C029 | *Valsaria rubricosa* AA | SEQ ID NO: 56 | aa |
| Linker | C030 | *Acremonium* sp. AA | SEQ ID NO: 57 | dna |
| Linker | C030 | *Acremonium* sp. AA | SEQ ID NO: 58 | aa |
| Linker | C031 | *Meripilus giganteus* AA | SEQ ID NO: 59 | dna |
| Linker | C031 | *Meripilus giganteus* AA | SEQ ID NO: 60 | aa |
| Linker | C032 | *Bacillus flavothermus* AA short linker | SEQ ID NO: 61 | dna |
| Linker | C032 | *Bacillus flavothermus* AA short linker | SEQ ID NO: 62 | aa |
| Linker | C033 | *Bacillus flavothermus* AA long linker | SEQ ID NO: 63 | dna |
| Linker | C033 | *Bacillus flavothermus* AA long linker | SEQ ID NO: 64 | aa |
| Linker | C034 | *Bacillus flavothermus* AA | SEQ ID NO: 65 | dna |
| Linker | C034 | *Bacillus flavothermus* AA | SEQ ID NO: 66 | aa |
| Linker | C035 | *Athelia rolfsii* GA | SEQ ID NO: 67 | dna |
| Linker | C035 | *Athelia rolfsii* GA | SEQ ID NO: 68 | aa |
| Linker | C036 | *Aspergillus kawachii* GA | SEQ ID NO: 69 | Dna |
| Linker | C036 | *Aspergillus kawachii* GA | SEQ ID NO: 70 | Aa |
| Linker | C037 | *Aspergillus niger* GA | SEQ ID NO: 71 | dna |
| Linker | C037 | *Aspergillus niger* GA | SEQ ID NO: 72 | aa |
| Linker | C038 | *Coniochaeta* sp. AA | SEQ ID NO: 73 | dna |
| Linker | C038 | *Coniochaeta* sp. AA | SEQ ID NO: 74 | aa |
| CBM | C039 | *Pachykytospora papayracea* GA | SEQ ID NO: 75 | dna |
| CBM | C039 | *Pachykytospora papayracea* GA | SEQ ID NO: 76 | aa |
| CBM | C040 | *Trametes cingulata* GA | SEQ ID NO: 77 | dna |
| CBM | C040 | *Trametes cingulata* GA | SEQ ID NO: 78 | aa |
| CBM | C041 | *Leucopaxillus gigantus* GA | SEQ ID NO: 79 | dna |
| CBM | C041 | *Leucopaxillus gigantus* GA | SEQ ID NO: 80 | aa |
| CBM | C042 | *Subulispora provurvata* AA | SEQ ID NO: 81 | dna |
| CBM | C042 | *Subulispora provurvata* AA | SEQ ID NO: 82 | aa |
| CBM | C043 | *Valsaria rubricosa* AA | SEQ ID NO: 83 | dna |
| CBM | C043 | *Valsaria rubricosa* AA | SEQ ID NO: 84 | aa |
| CBM | C044 | *Acremonium* sp. AA | SEQ ID NO: 85 | dna |
| CBM | C044 | *Acremonium* sp. AA | SEQ ID NO: 86 | aa |
| CBM | C045 | *Meripilus giganteus* AA | SEQ ID NO: 87 | dna |
| CBM | C045 | *Meripilus giganteus* AA | SEQ ID NO: 88 | aa |
| CBM | C046 | *Bacillus flavothermus* AA | SEQ ID NO: 89 | dna |
| CBM | C046 | *Bacillus flavothermus* AA | SEQ ID NO: 90 | aa |
| CBM | C047 | *Athelia rolfsii* GA | SEQ ID NO: 91 | dna |
| CBM | C047 | *Athelia rolfsii* GA | SEQ ID NO: 92 | aa |
| CBM | C048 | *Aspergillus kawachii* GA | SEQ ID NO: 93 | dna |
| CBM | C048 | *Aspergillus kawachii* GA | SEQ ID NO: 94 | aa |
| CBM | C049 | *Aspergillus niger* GA | SEQ ID NO: 95 | dna |
| CBM | C049 | *Aspergillus niger* GA | SEQ ID NO: 96 | aa |
| CBM | C050 | *Coniochaeta* sp. | SEQ ID NO: 97 | dna |
| CBM | C050 | *Coniochaeta* sp. | SEQ ID NO: 98 | aa |
| Hybrid | V051 | Hybrid of Fungamyl variant CD and *A. rolfsii* GA CBM | SEQ ID NO: 99 | dna |
| Hybrid | V051 | Hybrid of Fungamyl variant CD and *A. rolfsii* GA CBM | SEQ ID NO: 100 | aa |
| Hybrid | V019 | Hybrid of *R. pusillus* AA CD and *A. rolfsii* GA CBM | SEQ ID NO: 101 | aa |
| Hybrid | V022 | Hybrid of *M. giganteus* AA and *A. rolfsii* GA CBM | SEQ ID NO: 102 | aa |
| Plasmid | pLA1 | Plasmid | SEQ ID NO: 103 | dna |
| Primer | P001 | Primer | SEQ ID NO: 104 | dna |
| Primer | P002 | Primer | SEQ ID NO: 105 | dna |
| Primer | P003 | Primer | SEQ ID NO: 106 | dna |
| Primer | P004 | Primer | SEQ ID NO: 107 | dna |
| CBM | | *Zea mays* | SEQ ID NO: 108 | dna |

TABLE 2-continued

Amino acid (AA) and DNA sequences numbers of catalytic domains (CD), linkers, carbohydrate binding modules (CBM), plasmids, and primers applied. AA is alpha-amylase, GA is glucoamylase.

| Type | CODE | Sequence origin | SEQ ID | |
|---|---|---|---|---|
| CBM | | *Zea mays* | SEQ ID NO: 109 | aa |
| CD | C051 | *Thermoascus* sp. // | SEQ ID NO: 110 | dna |
| CD | C051 | *Thermoascus* sp. // AA | SEQ ID NO: 111 | aa |
| CD | C055 | *Coniochaeta* sp.// AA | SEQ ID NO: 112 | dna |
| CD | C055 | *Coniochaeta* sp.// AA | SEQ ID NO: 113 | aa |
| CD | C052 | *Nectria* sp. AA | SEQ ID NO: 114 | dna |
| CD | C052 | *Nectria* sp. AA | SEQ ID NO: 115 | aa |
| CD | C054 | *Fusarium* sp. AA | SEQ ID NO: 116 | dna |
| CD | C054 | *Fusarium* sp. AA | SEQ ID NO: 117 | aa |
| CD | C057 | *Trametes corrugate* AA | SEQ ID NO: 118 | dna |
| CD | C057 | *Trametes corrugate* AA | SEQ ID NO: 119 | aa |
| CD | C059 | *Penicillium* sp. AA | SEQ ID NO: 120 | dna |
| CD | C059 | *Penicillium* sp. AA | SEQ ID NO: 121 | aa |
| CD | C060 | *Valsaria spartii* AA | SEQ ID NO: 122 | dna |
| CD | C060 | *Valsaria spartii* AA | SEQ ID NO: 123 | aa |
| CD | C061 | *Thermoascus aurantiacus* AA | SEQ ID NO: 124 | dna |
| CD | C061 | *Thermoascus aurantiacus* AA | SEQ ID NO: 125 | aa |
| CD | C062 | *Phanerochaete chrysosporium* AA | SEQ ID NO: 126 | dna |
| CD | C062 | *Phanerochaete chrysosporium* AA | SEQ ID NO: 127 | aa |
| CD | C063 | *Rhizopus oryzae* AA | SEQ ID NO: 128 | dna |
| CD | C063 | *Rhizopus oryzae* AA | SEQ ID NO: 129 | aa |
| CD | C064 | *Thaminidium elegans* AA | SEQ ID NO: 130 | dna |
| CD | C064 | *Thaminidium elegans* AA | SEQ ID NO: 131 | aa |
| CD | C065 | *Absidia cristata* AA | SEQ ID NO: 132 | dna |
| CD | C065 | *Absidia cristata* AA | SEQ ID NO: 133 | aa |
| CD | C066 | *Syncephalastrum racemosum* AA | SEQ ID NO: 134 | dna |
| CD | C066 | *Syncephalastrum racemosum* AA | SEQ ID NO: 135 | aa |
| CBM | C067 | *Coniochaeta* sp. AA | SEQ ID NO: 136 | dna |
| CBM | C067 | *Coniochaeta* sp. AA | SEQ ID NO: 137 | aa |
| CBM | C068 | *Trametes corrugata* AA | SEQ ID NO: 138 | dna |
| CBM | C068 | *Trametes corrugata* AA | SEQ ID NO: 139 | aa |
| CBM | C069 | *Valsario spartii* AA | SEQ ID NO: 140 | dna |
| CBM | C069 | *Valsario spartii* AA | SEQ ID NO: 141 | aa |
| CBM | C070 | *Penicillium* sp. AA | SEQ ID NO: 142 | dna |
| CBM | C070 | *Penicillium* sp. AA | SEQ ID NO: 143 | aa |
| Linker | C072 | *Coniochaeta* sp. AA | SEQ ID NO: 144 | dna |
| Linker | C072 | *Coniochaeta* sp. AA | SEQ ID NO: 145 | aa |
| Linker | C073 | *Trametes corrugata* AA | SEQ ID NO: 146 | dna |
| Linker | C073 | *Trametes corrugata* AA | SEQ ID NO: 147 | aa |
| Linker | C074 | *Valsario spartii* AA | SEQ ID NO: 148 | dna |
| Linker | C074 | *Valsario spartii* AA | SEQ ID NO: 149 | aa |
| Linker | C075 | *Penicillium* sp. AA | SEQ ID NO: 150 | dna |
| Linker | C075 | *Penicillium* sp. AA | SEQ ID NO: 151 | aa |
| CD | C077 | *Streptomyces limosus* AA | SEQ ID NO: 154 | dna |
| CD | C077 | *Streptomyces limosus* AA | SEQ ID NO: 155 | aa |

Example 1

Construction of the Nucleic Acid Sequence V019, Encoding *Rhizomucor Pusillus* Alpha Amylases and *Athelia Rolfsii* Glucoamylase CBM Vector pLA1 was digested with the appropriate restriction endonuclease to cut out the region encoding *A. niger* alpha-amylase catalytic domain. The *Rhizomucor pusillus* alpha-amylase gene was amplified by PCR using the primers P001 (SEQ ID NO: 104) and P002 (SEQ ID NO: 105), the amplified fragment is shown as SEQ ID NO: 19.

| PCR reaction system: | | Conditions: | | |
|---|---|---|---|---|
| 38.9 micro L | H$_2$O | 1 | 98° C. 10 sec | |
| 5 micro L | 10 × reaction buffer | 2 | 68° C. 90 sec | |
| 1 micro L | Klen Taq LA (CLONTECH) | 1-2 | 30 cycles | |
| 4 micro L | 10 mM dNTPs | 3 | 68° C. 10 min | |
| 0.3 micro L × 2 | 100 pmole/micro L Primers | | | |
| 0.5 micro L | Template DNA | | | |

DNA fragments were recovered from agarose gel by the Qiagen gel extraction Kit. The resulting purified fragments were mixed with the vector digest. The mixed solution was introduced into *Saccharomyces cerevisiae* to construct the expression plasmid pLAV019 by in vivo recombination.

Example 2

Construction of the Nucleic Acid Sequence V022, Encoding *Meripilus Giganteus* Alpha Amylase and *Athelia Rolfsii* Glucoamylase CBM The *Meripilus giganteus* alpha-amylase gene was amplified by PCR using the primers P003 (SEQ ID NO: 106) and P004 (SEQ ID NO: 107).

DNA fragments were recovered from agarose gel by the Qiagen gel extraction Kit. The resulting purified fragments and the appropriate restriction endonuclease digested vector pLA1 to cut out the region encoding *A. niger* alpha-amylase catalytic domain were mixed. The mixed solution was introduced into *Saccharomyces cerevisiae* to construct the expression plasmid pLAV022 by in vivo recombination.

Example 3

Expression of Amylases with CBM in *Aspergillus oryzae*

The constructs comprising the alpha amylase genes with CBM described in examples 1 and 2 were used to construct expression vectors, pAspV019 and pAspV022, respectively.

The two plasmids, pAspV019 and pAspV022, consist of an expression cassette based on the *Aspergillus niger* neutral amylase II promoter fused to the *Aspergillus nidulans* triose phosphate isomerase non translated leader sequence (Pna2/tpi) and the *Aspergillus niger* amyloglycosidase terminator (Tamg). Also present on the plasmid was the *Aspergillus* selective marker amdS from *Aspergillus nidulans* enabling growth on acetamide as sole nitrogen source. The expression plasmids pAspV019 and pAspV022 were transformed into *Aspergillus* as described in Lassen et al., 2001, *Applied and Environmental Microbiology* 67: 4701-4707. Transformants expressing V019 and V022, were isolated, purified and cultivated in shake flasks. The culture broths from fermentations of *Aspergillus oryzae* expressing amylase with CBM were purified by affinity purification (*Biochem. J.* 372: 905-910 (2003)).

Example 4

Amylases with CBM

Polypeptides of the invention were produced; a selection of catalytic domains were fused to the linker-CBM region of *Athelia rolfsii* glucoamylase, and a selection of CBM regions were attached to the C003 *Aspergillus oryzae* catalytic domain (a Fungamyl PE variant).

Because the CBM+linker from *Trichophaea saccata* alpha-amylase is located at N-terminal, it was inserted between SP288 signal and the *Aspergillus oryzae* catalytic domain. The other CBMs were all C-terminally placed.

The variant V008 comprised both a C-terminally placed linker and CBM region of *Athelia rolfsii* glucoamylase and an N-terminally placed linker+CBM from *Trichophaea saccata* alpha-amylase.

CBM variants of the *Aspergillus oryzae* alpha-amylase and catalytic domain variants of the *Athelia rolfsii* glucoamylase CBM are listed in tables 3 and 4 respectively. Other produced polypeptides of the invention are listed in tables 5 and 6.

The variants have improved activity on starch, especially on granular starch.

TABLE 3

Polypeptides with the *A. oryzae* AA Fungamyl variant catalytic domain (SEQ ID NO: 6)

| Code | Linker and CBM from | CBM | Linker |
|---|---|---|---|
| V001 | *Sublispora provurvata* AA | SEQ ID NO: 82 | SEQ ID NO: 54 |
| V002 | *Valsaria rubricosa* | SEQ ID NO: 84 | SEQ ID NO: 56 |
| V003 | *Acremonium* sp. AA | SEQ ID NO: 86 | SEQ ID NO: 58 |
| V004 | *Pachykytospora papayracea* GA | SEQ ID NO: 76 | SEQ ID NO: 46 |
| V005 | *Trametes cingulata* GA | SEQ ID NO: 78 | SEQ ID NO: 48 |
| V006 | *Leucopaxillus gigantus* GA | SEQ ID NO: 80 | SEQ ID NO: 50 |
| V007 | *Meripilus giganteus* AA | SEQ ID NO: 88 | SEQ ID NO: 60 |
| V008 | *Trichophaea saccata* AA (CBM21-Nterm incl. linker) +*A. rolfsii* GA (C-term) | SEQ ID NO: 52 SEQ ID NO: 92 | SEQ ID NO: 68 |
| V009 | *Trichophaea saccata* AA (CBM21-Nterm incl. linker) | SEQ ID NO: 52 | |
| V010 | *Bacillus flavothermus* AA with short linker | SEQ ID NO: 90 | SEQ ID NO: 62 |
| V011 | *Bacillus flavothermus* AA with long linker | SEQ ID NO: 90 | SEQ ID NO: 64 |
| V012 | *Bacillus flavothermus* AA | SEQ ID NO: 90 | SEQ ID NO: 66 |

TABLE 4

Polypeptides with the *A. rolfsii* GA linker (SEQ ID NO: 68) and CBM (SEQ ID NO: 92)

| Code | Catalytic module from: | Catalytic domain SEQ ID |
|---|---|---|
| V013 | *Trichophaea saccata* AA | SEQ ID NO: 8 |
| V014 | *Subulispora provurvata* AA | SEQ ID NO: 10 |
| V015 | *Valsaria rubricosa* AA | SEQ ID NO: 12 |
| V016 | *Thermomyces lanuginosus* AA | SEQ ID NO: 14 |
| V017 | *Acremonium* sp. AA | SEQ ID NO: 16 |
| V018 | *Malbranchea* sp. AA | SEQ ID NO: 18 |
| V019 | *Rhizomucor pusillus* AA | SEQ ID NO: 20 |
| V021 | *Dichotomocladium hesseltinei* AA | SEQ ID NO: 22 |
| V022 | *Meripilus giganteus* AA | SEQ ID NO: 24 |
| V023 | *Stereum* sp. | SEQ ID NO: 26 |
| V024 | *Streptomyces limosus* AA | SEQ ID NO: 155 |
| V025 | *Coriolus censors* | SEQ ID NO: 30 |
| V026 | *Dinemasporium* sp. AA | SEQ ID NO: 32 |
| V027 | *Cryptosporiopsis* sp. AA | SEQ ID NO: 34 |
| V028 | *Coniochaeta* sp. AA | SEQ ID NO: 36 |
| V029 | *Diplodia* sp. AA | SEQ ID NO: 38 |
| V030 | *Nectria* sp. AA | SEQ ID NO: 40 |
| V031 | *Gliocladium* sp. AA | SEQ ID NO: 42 |
| V032 | *Streptomyces thermocyaneoviolaceus* AA | SEQ ID NO: 44 |
| V047 | *Thermoascus* sp. II | SEQ ID NO: 111 |
| V048 | *Coniochaeta* sp.2 | SEQ ID NO: 113 |
| V049 | *Nectria* sp. AA | SEQ ID NO: 115 |
| V050 | *Fusarium* sp. | SEQ ID NO: 117 |
| V051 | *Trametes corrugata* | SEQ ID NO: 119 |
| V052 | *Valsaria spartii* | SEQ ID NO: 123 |
| V054 | *Thermoascus aurantiacus* | SEQ ID NO: 125 |
| V055 | *Penicillium* sp. | SEQ ID NO: 121 |
| V057 | *Phanerochaete chrysosporium* | SEQ ID NO: 127 |
| V059 | *Rhizopus oryzae* | SEQ ID NO: 129 |
| V060 | *Thaminidium elegans* | SEQ ID NO: 131 |
| V061 | *Absidia cristata* | SEQ ID NO: 133 |
| V063 | *Syncephalastrum racemosum* | SEQ ID NO: 135 |

TABLE 5

Polypeptides with other catalytic domains/CBMs with linker.
In V069 CBM and linker are of different origin.

| Code | Catalytic domain from: | CD SEQ ID NO | CBM and linker from: | Linker SEQ ID NO | CBM SEQ ID NO |
|---|---|---|---|---|---|
| V033 | *Acremonium* sp. AA | SEQ ID NO: 16 | *Pachykytospora papayracea* GA | SEQ ID NO: 46 | SEQ ID NO: 145 |
| V034 | *Rhizomucor pusillus* AA | SEQ ID NO: 20 | *Pachykytospora papayracea* GA | SEQ ID NO: 46 | SEQ ID NO: 145 |
| V035 | *Meripilus giganteus* AA | SEQ ID NO: 24 | *Pachykytospora papayracea* GA | SEQ ID NO: 46 | SEQ ID NO: 145 |
| V036 | *Meripilus giganteus* AA | SEQ ID NO: 24 | *Valsaria rubricosa* | SEQ ID NO: 56 | SEQ ID NO: 84 |
| V037 | *Meripilus giganteus* AA | SEQ ID NO: 24 | *Meripilus giganteus* AA | SEQ ID NO: 60 | SEQ ID NO: 88 |
| V038 | *Rhizomucor pusillus* AA | SEQ ID NO: 20 | *Aspergillus kawachii* GA | SEQ ID NO: 70 | SEQ ID NO: 94 |
| V039 | *Rhizomucor pusillus* AA | SEQ ID NO: 20 | *Aspergillus niger* GA | SEQ ID NO: 72 | SEQ ID NO: 96 |
| V040 | *A. oryzae* Fungamyl variant | SEQ ID NO: 06 | *Coniochaeta* sp. AM603 | SEQ ID NO: 74 | SEQ ID NO: 98 |
| V069 | *Meripilus giganteus* AA | SEQ ID NO: 24 | *Zea mays* CBM *A. rolf* GA linker | SEQ ID NO: 68 | SEQ ID NO: 109 |

TABLE 6

Polypeptides with *Rhizomucor pusillus* AA catalytic domain
(SEQ ID NO: 20) and CBM and linker from:

| Code | CBM from | CBM SEQ ID NO | Linker from | Linker SEQ ID NO |
|---|---|---|---|---|
| V041 | *A. rolfsii* GA | SEQ ID NO: 92 | *A. kawachii* AA | SEQ ID NO: 70 |
| V042 | *A. rolfsii* GA | SEQ ID NO: 92 | *A. niger* GA | SEQ ID NO: 72 |
| V043 | *Zea mays* | SEQ ID NO: 109 | *A. rolf* GA | SEQ ID NO: 68 |
| V064 | *Coniochaeta* sp. | SEQ ID NO: 113 | *Coniochaeta* sp. | SEQ ID NO: 145 |
| V065 | *Trametes corrugata* | SEQ ID NO: 119 | *Trametes corrugata* | SEQ ID NO: 147 |
| V066 | *Valsaria spartii* | SEQ ID NO: 123 | *Valsaria spartii* | SEQ ID NO: 149 |
| V067 | *Penicillium* sp. | SEQ ID NO: 121 | *Penicillium* sp. | SEQ ID NO: 151 |
| V068 | *Meripulus giganteus* | SEQ ID NO: 88 | *Meripulus giganteus* | SEQ ID NO: 60 |

Example 5

The performance of the polypeptide V019 was evaluated in mini-scale fermentations with different dosages of *Talaromyces emersonii* glucoamylase. Starch substrate, 583.3 g of ground corn was added to 912.2 g tap water. This mixture was supplemented with 4.5 ml of a 1 g/L penicillin solution. The pH of this slurry was adjusted to 5.0 with 40% $H_2SO_4$. DS level was determined in duplicate to be 34.2±0.8%. Approximately 5 g of this slurry was added to 20 ml vials. Each vial was dosed with the appropriate amount of enzyme followed by addition of 200 microL yeast propagate/5 g slurry. Actual dosages were based on the exact weight of corn slurry in each vial. Vials were incubated at 32° C. Fermentations were followed by measuring weight loss over time. At 70 hours the fermentations were stopped and prepared for HPLC analysis. The HPLC preparation consisted of stopping the reaction by addition of 50 microL of 40% $H_2SO_4$, centrifuging, and filtering through a 0.45 micrometer filter. Samples awaiting HPLC analysis were stored at 4° C.

TABLE 7

Performance of polypeptide V019 in mini-scale fermentations.
70 hr Ethanol relative to 0.14 AGU/DS and no alpha-amylase.

| Amylase Dose (mg Protein/g DS) | *T. emersonii* GA Dose (AGU/g DS) | 70 hr Ethanol |
|---|---|---|
| 0 | 0.14 | 1.00 |
| 0 | 0.50 | 1.35 |
| 0 | 0.86 | 1.73 |
| 0.05 | None | 3.69 |
| 0.05 | 0.14 | 3.69 |
| 0.05 | 0.50 | 3.73 |
| 0.05 | 0.86 | 3.73 |

Example 6

Substrates for saccharification were prepared by dissolving a DE 11 maltodextrin prepared from corn starch liquefied with thermostable bacterial alpha-amylase (LIQUOZYME X™, Novozymes A/S) in Milli-Q™ water, and adjusting the dry solid matter content (DS) to 30%. The saccharification experiments were carried out in sealed 2 ml glass vials at 60° C. and initial pH of 4.3 under continuous stirring. Two different dosages of CBM alpha-amylase V019 or V022 were applied on top of a standard treatment with *Talaromyces emersonii* glucoamylase 0.35 AGU/g DS and *A. niger* acid alpha-amylase 0.04 AFAU/g DS.

Samples were taken at set intervals and heated in boiling water for 15 minutes to inactivate the enzymes. After cooling, the samples were diluted to 5% DS and filtered (Sartorius MINISART™ NML 0.2 micro-m), before being analysed by HPLC. The glucose levels as a % of total soluble carbohydrate are given in table 8 below.

TABLE 8

All treatments with *Talaromyces emersonii* glucoamylase 0.35 AGU/g DS and *A. niger* acid alpha-amylase 0.04 AFAU/g DS. Acid alpha-amylase variants V019 and V022 were dosed on top according to the table.

| Additional Enzyme | Acid alpha-amylase variant AFAU/g DS | DP1 24 h | 48 h | 70 h |
|---|---|---|---|---|
| Control | 0 | 81.5 | 90.2 | 93.1 |
| V019 | 0.0875 | 95.7 | 96.2 | 95.6 |
|  | 0.1750 | 92.1 | 96.2 | 96.2 |
| V022 | 0.0875 | 93.8 | 95.6 | 95.5 |
|  | 0.1750 | 92.9 | 95.9 | 96.0 |

Example 6

Raw starch SSF treatments were evaluated in mini-scale fermentations. A 35% DS granular starch slurry was obtained from mixing 410 g finely ground corn, 590 ml tap water, 3.0 mls 1 g/L penicillin and 1 g of urea. The slurry was adjusted to pH 4.5 using 5 N NaOH and samples of 5 g were distributed to 20 ml vials. The appropriate amount of enzymes was dosed and the vials were inoculated with yeast. Vials were incubated at 32° C. 9 replicate fermentations of each treatment were run. Three replicates were selected for 24 hours, 48 hours and 70 hours time point analysis. Vials were vortexed at 24, 48 and 70 hours. The time point analysis consisted of weighing the vials and prepping the sample for HPLC. For HPLC the reaction was stopped by addition of 50 microL of 40% $H_2SO_4$, centrifuging, and filtering through a 0.45 um filter. Samples awaiting HPLC analysis were stored at 4° C.

Example 6a

Enzymes and amounts used are shown in the table below. A-AMG is an *Aspergillus niger* glucoamylase composition.

TABLE 9

Raw starch SSF with *Aspergillus niger* glucoamylase and V019, enzyme dosage

| trial No | % dose A-AMG | V019 | mg/gDS A-AMG | V019 | AGU/gDS A-AMG | AFAU/gDS V019 |
|---|---|---|---|---|---|---|
| 2 | 100% | 0% | 0.5 | 0 | 0.95 | 0 |
| 3 | 90% | 10% | 0.45 | 0.01 | 0.855 | 0.01 |
| 4 | 80% | 20% | 0.4 | 0.02 | 0.76 | 0.02 |
| 5 | 70% | 30% | 0.35 | 0.03 | 0.665 | 0.03 |
| 6 | 60% | 40% | 0.3 | 0.04 | 0.57 | 0.04 |
| 7 | 45% | 55% | 0.225 | 0.055 | 0.4275 | 0.055 |
| 8 | 30% | 70% | 0.15 | 0.07 | 0.285 | 0.07 |
| 9 | 15% | 85% | 0.075 | 0.085 | 0.1425 | 0.085 |
| 10 | 0% | 100% | 0 | 0.1 | 0 | 0.1 |

Good ethanol yield after 70 hours fermentation was observed in the range of 1.7-85.5 AGU/AFAU ratio of *A. niger* AMG to V019, indicating robust performance in a broad activity ratio range for the mixtures of *A. niger* AMG to V019.

TABLE 10

Raw starch SSF with *Aspergillus niger* glucoamylase and V019, results

| Trial No | AGU/gDS A-AMG | AFAU/gDS V019 | Ethanol Yield (g/l) 24 hr | 48 hr | 70 hr | AGU/AFAU Ratio |
|---|---|---|---|---|---|---|
| 2 | 0.950 | 0.000 | 77.73 | 119.46 | 139.27 | N/A |
| 3 | 0.855 | 0.010 | 92.93 | 134.65 | 144.39 | 85.5 |
| 4 | 0.760 | 0.020 | 93.13 | 133.74 | 145.42 | 38.0 |
| 5 | 0.665 | 0.030 | 92.66 | 134.32 | 147.56 | 22.2 |
| 6 | 0.570 | 0.040 | 91.68 | 132.86 | 145.77 | 14.3 |
| 7 | 0.428 | 0.055 | 90.17 | 130.87 | 146.26 | 7.8 |
| 8 | 0.285 | 0.070 | 87.11 | 127.74 | 144.82 | 4.1 |
| 9 | 0.143 | 0.085 | 84.32 | 120.95 | 143.40 | 1.7 |
| 10 | 0.000 | 0.100 | 80.80 | 114.55 | 134.08 | 0.0 |

Example 6b

Enzymes and amounts used are shown in the table below. A-AMG is a *Talaromyces emersonii* glucoamylase composition.

TABLE 11

Raw starch SSF with *Talaromyces emersordi* glucoamylase and V019, enzyme dosages

| trial No | % dose T-AMG | V019 | mg/gDS T-AMG | V019 | AGU/gDS T-AMG | AFAU/gDS V019 |
|---|---|---|---|---|---|---|
| 2 | 100% | 0% | 0.3 | 0 | 2.4 | 0 |
| 3 | 90% | 10% | 0.27 | 0.01 | 2.16 | 0.01 |
| 4 | 80% | 20% | 0.24 | 0.02 | 1.92 | 0.02 |
| 5 | 70% | 30% | 0.21 | 0.03 | 1.68 | 0.03 |
| 6 | 60% | 40% | 0.18 | 0.04 | 1.44 | 0.04 |
| 7 | 45% | 55% | 0.135 | 0.055 | 1.08 | 0.055 |
| 8 | 30% | 70% | 0.09 | 0.07 | 0.72 | 0.07 |
| 9 | 15% | 85% | 0.045 | 0.085 | 0.36 | 0.085 |
| 10 | 0% | 100% | 0 | 0.1 | 0 | 0.1 |

Good ethanol yield after 70 hours fermentation was observed in the range of 10-216 AGU/AFAU ratio of *T. emersonii* AMG to V019, indicating a broad activity ratio range for the mixtures of *T. emersonii* AMG to V019.

TABLE 12

Raw starch SSF with *Talaromyces emersonii* glucoamylase and V019, results

| trial No | AGU/gDS Sp Fuel | AGU/ AFAU/gDS V019 | Ethanol Yield (g/l) | | | AFAU Ratio |
|---|---|---|---|---|---|---|
| | | | 24 hrs | 48 hrs | 70 hrs | |
| 2 | 2.4 | 0 | 60.07 | 91.77 | 113.17 | N/A |
| 3 | 2.16 | 0.01 | 89.00 | 129.36 | 142.91 | 216.0 |
| 4 | 1.92 | 0.02 | 91.02 | 132.07 | 147.18 | 96.0 |
| 5 | 1.68 | 0.03 | 93.31 | 133.75 | 148.19 | 56.0 |
| 6 | 1.44 | 0.04 | 93.71 | 134.16 | 146.84 | 36.0 |
| 7 | 1.08 | 0.055 | 92.83 | 131.53 | 141.80 | 19.6 |
| 8 | 0.72 | 0.07 | 91.25 | 125.48 | 139.25 | 10.3 |
| 9 | 0.36 | 0.085 | 86.14 | 124.22 | 137.38 | 4.2 |
| 10 | 0 | 0.1 | 80.63 | 115.00 | 132.08 | 0.0 |

Deposit of Biological Material

The following biological material has been deposited under the terms of the Budapest Treaty at Deutshe Sammmlung von Microorganismen and Zellkulturen GmbH (DSMZ), Mascheroder Weg 1b, D-38124 Braunschweig DE, and given the following accession number:

| Deposit | Accession Number | Date of Deposit |
|---|---|---|
| *Escherichia coli* NN049798 | DSM 17106 | 2 February 2005 |
| *Escherichia coli* NN049797 | DSM 17105 | 2 February 2005 |

The strains have been deposited under conditions that assure that access to the culture will be available during the pendency of this patent application to one determined by the Commissioner of Patents and Trademarks to be entitled thereto under 37 C.F.R. §1.14 and 35 U.S.C. §122. The deposits represent a substantially pure culture of the deposited strain. The deposits are available as required by foreign patent laws in countries wherein counterparts of the subject application, or its progeny are filed. However, it should be understood that the availability of a deposit does not constitute a license to practice the subject invention in derogation of patent rights granted by governmental action.

SEQUENCE LISTING (179 sequences)

SEQ ID NO: 1 - DNA, 1533 bp, Aspergillus niger
  CDS (1)..(1533)
atgagattatcgacttcgagtctcttcctttccgtgtctctgctggggaagctggccctcgggctgtcggctgcagaatggcgcactcagtcgatttacttcctattgacggatcggttcggtaggacggacaattcgacgacagctacatgcgatacgggtgaccaaatctattgtggtggcagttggcaaggaatcatcaaccatctggattatatccagggcatgggattcacggccatctggatctcgcctatcactgaacagctgccccaggatactgctgatggtgaagcttaccatggatattggcagcagaagatatacgacgtgaactccaacttcggcactgcagatgacctcaagtccctctcagatgcgcttcatgcccgcggaatgtacctcatggtggacgtcgtccctaaccacatgggctacgccggcaacggcaacgatgtagactacagcgtcttcgaccccttcgattcctcctcctacttccacccatactgcctgatcacagattgggacaacttgaccatggtccaagattgttgggagggtgacaccatcgtatctctgccagacctaaacaccaccgaaactgccgtgagaacaatctggtatgactgggtagccgacctggtatccaattattcagtcgacggactccgcatcgacagtgtcctcgaagtcgaaccagacttcttcccgggctaccaggaagcagcaggtgtctactgcgtcggcgaagtcgacaacggcaaccctgccctcgactgcccataccagaaggtcctggacggcgtcctcaactatccgatctactggcaactcctctacgccttcgaatcctccagcggcagcatcagcaatctctacaacatgatcaaatccgtcgcaagcgactgctccgatccgacactactcggcaacttcatcgaaaaccacgacaatccccgtttcgcctcctacacctccgactactcgcaagccaaaaacgtcctcagctacatcttcctctccgacggcatccccatcgtctacgccggcgaagaacagcactactccggcggcaaggtgccctacaaccgcgaagcgacctggctttcaggctacgacacctccgcagagctgtacacctggatagccaccacgaacgcgatccgcaaactagccatctcagctgactcggcctacattacctacgcgaatgatgcattctacactgacagcaacaccatcgcaatgcgcaaaggcacctcagggagccaagtcatcaccgtcctctccaacaaaggctcctcaggaagcagctacaccctgaccctcagcggaagcggctacacatccggcacgaagctgatcgaagcgtacacatgcacatccgtgaccgtggactcgagcggcgatattcccgtgccgatggcgtcgggattaccgagagttcttctgcccgcgtccgtcgtcgatagctcttcgctctgtggcgggagcggaagaacaaccacgaccacaactgctgctactagt

SEQ ID NO: 2 - protein, 511 aa, Aspergillus niger
MRLSTSSLFLSVSLLGKLALGLSAAEWRTQSIYFLLTDRFGRTDNSTTATCDTGDQIYCGGSWQGIINHLDYIQGMGFTAIWISPITEQLPQDTADGEAYHGYWQQKIYDVNSNFGTADDLKSLSDALHARGMYLMVDVVPNHMGYAGNGNDVDYSVFDPFDSSSYFHPYCLITDWDNLTMVQDCWEGDTIVSLPDLNTTETAVRTIWYDWVADLVSNYSVDGLRIDSVLEVEPDFFPGYQEAAGVYCVGEVDNGNPALDCPYQKVLDGVLNYPIYWQLLYAFESSSGSISNLYNMIKSVASDCSDPTLLGNFIENHDNPRFASYTSDYSQAKNVLSYIFLSDGIPIVYAGEEQHYSGGKVPYNREATWLSGYDTSAELYTWIATTNAIRKLAISADSAYITYANDAFYTDSNTIAMRKGTSGSQVITVLSNKGSSGSSYTLTLSGSGYTSGTKLIEAYTCTSVTVDSSGDIPVPMASGLPRVLLPASVVDSSSLCGGSGRTTTTTTAATS

SEQ ID NO: 3 - DNA, 1440 bp, Aspergillus oryzae
  CDS (1)..(1440)
gcaacgcctgcggactggcgatcgcaatccatttatttccttctcacggatcgatttgcaaggacggatgggtcgacgactgcgacttgtaatactgcggatcagaaatactgtggtggaacatggcagggcatcatcgacaagttggactatatccagggaatgggcttcacagccatctggatcacccccgttacagcccagctgccccagaccaccgcatatggagatgcctaccatggctactggcagcaggatatatactctctgaacgaaaactacggcactgcagatgacttgaaggcgctctcttcggcccttcatgagagggggatgtatcttatggtcgatgtggttgctaaccatatgggctatgatggagcgggtagctcagtcgattacagtgtgtttaaaccgttcagttcccaagactacttccacccgttctgtttcattcaaaactatgaagatcagactcaggttgaggattgctggctaggagataacactgtctccttgcctgatctcgataccaccaaggatgtggtcaagaatgaatggtacgactgggtgggatcattggtatcgaactactccattgacggcctccgtatcgacacagtaaaacacgtccagaaggacttctggcccgggtacaacaaagccgcaggcgtgtactgtatcggcgaggtgctcgacggtgatccggcctacacttgtccctaccagaacgtcatggacggcgtactgaactatcccatttactatccactcctcaacgccttcaagtcaacctccggcagcatggacgacctctacaacatgatcaacaccgtcaaatccgactgtccagactcaacactcctgggcacattcgtcgagaaccacgacaacccacggttcgcttcttacaccaacgacatagccctcgccaagaacgtcgcagcattcatcatcctcaacgacggaatccccatcatctacgccggccaagaacagcactacgccggcggaaacgaccccgcgaaccgcgaagcaacctggctctcgggctacccgaccgacagcgagctgtacaagttaattgcctccgcgaacgcaatccggaactatgccattagcaaagatacaggattcgtgacctacaagaactggcccatctacaaagacgacacaacgatcgccatgcgcaagggcacagatgggtcgcagatcgtgactatcttgtccaacaagggtgcttcgggtgattcgtataccctctccttgagtggtgcgggttacacagccggccagcaattgacggaggtcattggctgcacgaccgtgacggttggttcggatggaaatgtgcctgttcctatggcaggtgggctacctagggtattgtatccgactgagaagttggcaggtagcaagatctgtagtagctcgggaaga

SEQ ID NO: 4 - protein, 480 aa, Aspergillus oryzae
ATPADWRSQSIYFLLTDRFARTDGSTTATCNTADQKYCGGTWQGIIDKLDYIQGMGFTAIWITPVTAQLPQTTAYGDAYHGYWQQDIYSLNENYGTADDLKALSSALHERGMYLMVDVVANHMGYDGAGSSVDYSVFKPFSSQDYFHPFCFIQNYEDQTQVEDCWLGDNTVSLPDLDTTKDVVKNEWYDWVGSLVSNYSIDGLRIDTVKHVQKDFWPGYNKAAGVYCIGEVLDGDPAYTCPYQNVMDGVLNYPIYYPLLNAFKSTSGSMDDLYNMINTVKSDCPDSTLLGTFVENHDNPRFASYTNDIALAKNVAAFIILNDGIPIIYAGQEQHYAGGNDPANREATWLSGYPTDSELYKLIASANAIRNYAISKDTGFVTYKNWPIYKDDTTIAMRKGTDGSQIVTILSNKGASGDSYTLSLSGAGYTAGQQLTEVIGCTTVTVGSDGNVPVPMAGGLPRVLYPTEKLAGSKICSSSGR

SEQ ID NO: 5 - DNA, 1434 bp, Aspergillus oryzae
  CDS (1)..(1434)
gcaacgcctgcggactggcgatcgcaatccatttatttccttctcacggatcgatttgcaaggacggatgggtcgacgactgcgacttgtaatactgcggatcagaaatactgtggtggaacatggcagggcatcatcgacaagttggactatatccagggaatgggcttcacagccatctggatcacccccgttacagcccagctgccccagaccaccgcatatggagatgcctaccatggctactggcagcaggatatatactctctgaacgaaaactacggcactgcagatgacttgaaggcgctctcttcggcccttcatgagagggggatgtatcttatggtcgatgtggttgctaaccatatgggctatgatggaccgggtagctcagtcgattacagtgtgtttgttccgttcaattccgctagctacttccacccgttctgtttcattcaaaactggaatgatcagactcaggttgaggattgctggctaggagataacactgtctccttgcctgatctcgataccaccaaggatgtggtcaagaatgaatggtacgactgggtgggatcattggtatcgaactactccattgacggcctccgtatcgacacagtaaaacacgtccagaaggacttctggcccgggtacaacaaagccgcaggcgtgtactgtatcggcgaggtgctcgacggtgatccggcctacacttgtccctaccaggaagtcctggacggcgtactgaactaccccatttactatccactcctcaacgccttcaagtcaacctccggcagcatggacgacctctacaacatgatcaacaccgtcaaatccgactgtccagactcaacactcctgggcacattcgtcgagaaccacgacaacccacggttcgcttcttacaccaacgacatagccctcgccaagaacgtcgcagcattcatcatcctcaacgacggaatccccatcatctacgccggccaagaacagcactacgccggcggaaacgaccccgcgaaccgcgaagcaacctggctctcgggctacccgaccgacagcgagctgtacaagttaattgcctccgcgaacgcaatccggaactatgccattagcaaagatacaggattcgtgacctacaagaactggcccatctacaaagacgacacaacgatcgccatgcgcaagggcacagatgggtcgcagatcgtgactatcttgtccaacaagggtgcttcgggtgattcgtataccctctccttgagtggtgcgggttacacagccggccagcaattgacggaggtcattggctgcacgaccgtgacggttgattcgtcgggagatgtgcctgttcctatggcgggtgggctacctagggtattgtatccgactgagaagttggcaggtagcaagatctgtagtagctcg

SEQ ID NO: 6 - protein, 478 aa, Aspergillus oryzae
ATPADWRSQSIYFLLTDRFARTDGSTTATCNTADQKYCGGTWQGIIDKLDYIQGMGFTAIWITPVTAQLPQTTAYGDAYHGYWQQDIYSLNENYGTADDLKALSSALHERGMYLMVDVVANHMGYDGPGSSVDYSVFVPFNSASYFHPFCFIQNWNDQTQVEDCWLGDNTVSLPDLDTTKDVVKNEWYDWVGSLVSNYSIDGLRIDTVKHVQKDFWPGYNKAAGVYCIGEVLDGDPAYTCPYQEVLDGVLNYPIYYPLLNAFKSTSGSMDDLYNMINTVKSDCPDSTLLGTFVENHDNPRFASYTNDIALAKNVAAFIILNDGIPIIYAGQEQHYAGGNDPANREATWLSGYPTDSELYKLIASANAIRNYAISKDTGFVTYKNWPIYKDDTTIAMRKGTDGSQIVTILSNKGASGDSYTLSLSGAGYTAGQQLTEVIGCTTVTVDSSGDVPVPMAGGLPRVLYPTEKLAGSKICSSS

SEQ ID NO: 7 - DNA, 1461 bp, Trichophaea saccata
  CDS (1)..(1461)
tcatccggcaagaaattagagctggaggccctcaactttgtttggcagaatgcagttcttactggcgctcagagcactttcaacaatgggcagaagggcgctattgtggagctttttgggtggccgtatgcagatattgcaaaggagtgcgctttccttggaaaagccggatacatgggagtcaaggtttggcctccaaacgagcacatctggggatcggactactacgaaaccgacaatatgttccgtccgtggtatctggtgtaccagccggtcagttacaagcttgtgagccgtcaaggaacccgtgaggagcttcgagctatgataactgcttgccggagtgctggagtgcgcgtctatgccgacgccgtcattaatcacatgtctggaaacggaaacgatatccaaaaccatcgtaataccgcctgcgcctactggacaggccacaacgcaaccgcgaattcgccttacttcacctccggttacacctatcttattaatcccttcacgaacacacgccccaccttcgagtacccagcggtaccatggggcccaactgatttccattgcgtttcctctatcacagattggaccaacggccaaatcgtcacaaagggctatctcgtgggactctccgatctcaacacagagaaggattacgtccaggaccgcatcgccacttatcttgtggatctcttgtcaatcggcttctccggcttccgtgttgatgcggcaaaacatattggccccacctccatggcacagatcttcggaagggttgcaaagaagatgggcggaagtcttccagatgattttatcacttggcttgaagtgttgatgggtggtgagaaggagcagtatgcttgcggcggcggtgaatggagttggtacaccaacttcaatacccagctttccaatgcgggaattagtgacactgatatcaataagatcaagatttggagctccgactatcccaaggagttcccgatctgcggttcttggatcatcccatccactcgctttgtcatccaaaatgacgaccatgaccagcagaacccgggctcttcctccagagatatgggtgaccaaggctccgtactcatcaaagatcaagatgtagccaagcaccgggcatttgaggtcaagctcttcacccgtaccgacggtgactggcaaatcaggaatatcctctcctcttatatgtttgcctccaacggagcaaatggcttccccgatggtctttcggattgttccctttatactggctcacagagtgcgagtggttgtttgggtatcgcgaaggataccgcttatgtagaaggtatctgtgggtatactatggttgctggaaggtacaccaggccgcatagggatctgagcatcattaatgctatgaggagttgggtcgggttgtcgagtaccacagcggatgctcttggaatccccggttgtagctga

SEQ ID NO: 8 - protein, 486 aa, Trichophaea saccata
SSGKKLELEALNFVWQNAVLTGAQSTFNNGQKGAIVELFGWPYADIAKECAFLGKAGYMGVKVWPPNEHIWGSDYYETDNMFRPWYLVYQPVSYKLVSRQGTREELRAMITACRSAGVRVYADAVINHMSGNGNDIQNHRNTACAYWTGHNATANSPYFTSGYTYLINPFTNTRPTFEYPAVPWGPTDFHCVSSITDWTNGQIVTKGYLVGLSDLNTEKDYVQDRIATYLVDLLSIGFSGFRVDAAKHIGPTSMAQIFGRVAKKMGGSLPDDFITWLEVLMGGEKEQYACGGGEWSWYTNFNTQLSNAGISDTDINKIKIWSSDYPKEFPICGSWIIPSTRFVIQNDDHDQQNPGSSSRDMGDQGSVLIKDQDVAKHRAFEVKLFTRTDGDWQIRNILSSYMFASNGANGFPDGLSDCSLYTGSQSASGCLGIAKDTAYVEGICGYTMVAGRYTRPHRDLSIINAMRSWVGLSSTTADALGIPGCS

SEQ ID NO: 9 - DNA, 1398 bp, Subulispora provurvata
  CDS (1)..(1398)
accgaatgggggagtcagtccatctaccaggtattgacggatcgctttgcccgcactgatgggtctactaccgcctcctgtgatgtgaacaagtactgcggcggcacctggcagggcataatcgacaagctggactacatccagggcatgggtttcactgcgatctggatttcgcctatcgtcgacaacatcgacgccgatactgttgatggcacctcttatcacggttactgggcccaggacatcacctcagtgaactcggcgttcggcacggagcaggacctcatcaacctctcagcagctctgcacgacaggggcatgtatctgatggtagacgtggtaaacaaccacatgggatacaacggctgcggcgattgtgttgactacagcatatacacgccattcaaccagcagtcctactaccacccgtactgcgccactgattacagcaacctgacctccatccaggtgtgctgggagggtgacaacattgtcagtctccccgacctgaggacagaggatgacgatgtccgcaccatgtggtacgactggatcacgccgttggtaaccaagtactcgatcgatggactgcgcatggacagcgccgagcatgtcgagaagagcttctggcctggttgggtatccgcctcgggagtatacaacataggagaggttgatgagggcgaccccaccatcttcccagactggctgaactacatcgacggaaccttgaactatccagcttactactggatcactcaagctttccagtcaacttctggttctatcagcaacctggttaatggaatcaaccaaatgaagggctcaatgaaaaccagcaccctcgggtcgttccttgagaatcacgaccagccacgattcccttctctgactagtgatgcggatttggcgaagaacgctatcgcttttgctatgcttgctgatggcgtcccaatcgtctactatggtcaagagcaggcctactcgggtggtggcgtgcctaatgaccgtgagccactgtggacatcgggatacagcaccacatcggcaggttacacgttcatcacgaccatcaacaaaatccgccgcctggctctcacccaggacagtgcctacgtagcataccagacctacccgatctattcggattctcacgtcatcgccatgaagaagagcagcgtcgtctccgtctatagcaacattggctccagcggcagcacctattcgatcaccctacctgccggcacattcactgggagtgtagcgctcacagacgtggtgagctgccagacgtacacggcgagctctactggcagcctcaccttcaccttcggacaagttccctccgtcttctacccgacggcaagcctgtccggcagcgggctctgctctagctcc

SEQ ID NO: 10 - protein, 466 aa, Subulispora provurvata
TEWGSQSIYQVLTDRFARTDGSTTASCDVNKYCGGTWQGIIDKLDYIQGMGFTAIWISPIVDNIDADTVDGTSYHGYWAQDITSVNSAFGTEQDLINLSAALHDRGMYLMVDVVNNHMGYNGCGDCVDYSIYTPFNQQSYYHPYCATDYSNLTSIQVCWEGDNIVSLPDLRTEDDDVRTMWYDWITPLVTKYSIDGLRMDSAEHVEKSFWPGWVSASGVYNIGEVDEGDPTIFPDWLNYIDGTLNYPAYYWITQAFQSTSGSISNLVNGINQMKGSMKTSTLGSFLENHDQPRFPSLTSDADLAKNAIAFAMLADGVPIVYYGQEQAYSGGGVPNDREPLWTSGYSTTSAGYTFITTINKIRRLALTQDSAYVAYQTYPIYSDSHVIAMKKSSVVSVYSNIGSSGSTYSITLPAGTFTGSVALTDVVSCQTYTASSTGSLTFTFGQVPSVFYPTASLSGSGLCSSS

SEQ ID NO: 11 - DNA, 1350 bp, Valsaria rubricosa
  CDS (1)..(1350)
agcaactccgactggaggtcccgcaatatctactttgccttgaccgaccgcgtcgccaatccgtccaccacgaccgcatgtagtgacctgagcaactactgcggcggcacgtggagcggcctgtcgagcaagctggactacatccaagggatgggcttcgattccatctggattacccccgtggtcgagaactgcgacggtggctaccacggctactgggccaaggcgctctacaacgtcaacacgaactacggcagtgcggatgatctgaagaacttcgttgcggccgcccatgcgaagggcatgtacgtgatggtggacgtcgtcgcgaatcacatgggttcctgcggcatcgccaacctctccccacctcccctgaacgagcagagctcttatcacacccagtgcgacattgactacagcagtcagtccagcattgagacgtgctggatatccggcctccctgacctggacaccaccgatagcactatccgatccctcttccagacctgggtccacggcctggtcagcaactacagcttcgacggtctccgcgtcgacaccgtcaagcacgtggagaaggattactggcccggcttcgtgtcggcggcgggcacctacgccatcggcgaagtcttctccggcgacacctcctacgtggccggctatcaatcggtgatgccgggcttgctcaactatcccatctactatccgctcatccgcgtcttcgcgcagggtgcgtccttcaccgatctcgtcaacaaccacgataccgtcggctcgaccttctccgacccgacgctgctgggtaactttatcgacaaccacgacaacccacgtttcctgagctacaccagcgaccacgccctcctcaagaacgctctggcctacgtcatcctggccagaggcatccccatcgtctactacggcaccgagcaaggctactcgggttcgtccgacccggcgaaccgcgaggatctctggcgtagcggatacagcactacgggagacatctacaccaccatcgccgcgctctccgccgcgcgcaccgcggccggtggcctcgccggtaacgaccacgtccacctgtacacgaccgacaacgcgtacgcctggtcccgggcgagcggcaagctcatcgtcgtcacgtccaaccgcggcagctccgacagcagcaccatctgcttcagcacccagcaggccagcggcaccacctggaccagcacgatcaccggcaactcgtacaccgccgacagcaacggccagatctgcgtgcagctgtccagcggcggacccgaggcgctcgtcgtctccaccgcgaccggcaccgccaccgcgacgactctgtcc

SEQ ID NO: 12 - protein, 450 aa, Valsaria rubricosa
SNSDWRSRNIYFALTDRVANPSTTTACSDLSNYCGGTWSGLSSKLDYIQGMGFDSIWITPVVENCDGGYHGYWAKALYNVNTNYGSADDLKNFVAAAHAKGMYVMVDVVANHMGSCGIANLSPPPLNEQSSYHTQCDIDYSSQSSIETCWISGLPDLDTTDSTIRSLFQTWVHGLVSNYSFDGLRVDTVKHVEKDYWPGFVSAAGTYAIGEVFSGDTSYVAGYQSVMPGLLNYPIYYPLIRVFAQGASFTDLVNNHDTVGSTFSDPTLLGNFIDNHDNPRFLSYTSDHALLKNALAYVILARGIPIVYYGTEQGYSGSSDPANREDLWRSGYSTTGDIYTTIAALSAARTAAGGLAGNDHVHLYTTDNAYAWSRASGKLIVVTSNRGSSDSSTICFSTQQASGTTWTSTITGNSYTADSNGQICVQLSSGGPEALVVSTATGTATATTLS

SEQ ID NO: 13 - DNA, 1326 bp, Thermomyces lanuginosus
  CDS (1)..(1326)
aaatattgcgggggaacatggcgaggtatcatcaacaacctggattacatccaggatatgggcttcacagctatctggattactccagtgacagcccagtgggacgacgatgtggatgcggcagatgcaacgtcgtatcacggttattggcagaaagacctatactctctgaattcgaaattcggcactgccgatgacttgaaagccctggctgatacccttcacgcccgtgggatgcttctcatggtcgacgtcgtggctaatcactttggctacggcggttctcatagcgaggtggattactcgatcttcaatcctctgaacagccaggattacttccacccgttctgtctcattgaggactacgacaaccaggaagaagtcgaacaatgctggctggccgatactccgacgacattgcccgacgtggacaccaccaatcctcaggttcggacgtttttcaacgactggatcaagagcctggtggcgaactactccatcgatggtctgcgcgtcgacaccgttaagcacgtggagaaagatttctggcccgacttcaacgaagctgctggcgtgtacgccgtcggcgaggtgttcaacggtgacccagcgtacacctgcccataccaggaagtgctggatggcgttctgaactatccgatctactatcctgcgcttgatgcattcaagtctgtcggcggcaatctcggcggcttggctcaggccatcaccaccgtgcaggagagctgcaaggattccaatctgctcggcaatttccttgagaatcacgacattgctcgctttgcttcgtacacggatgaccttgctctcgccaagaatggtctcgctttcatcatcctctcggatggtattccgatcatctacgcgggccaggagcagcactacgccggtgatcacgatcccacaaatcgtgaggccgtctggctgtctggctacaataccgacgccgagctgtaccagttcatcaagaaggccaatggcatccgcaacttggctatcagccagaacccggaattcacctcctccaagaccaaggtcatctaccaagacgattcgacccttgccattaaccggggcggcgtcgttactgtcctgagcaatgaaggcgcctccggcggagaccggactgtctccattccgggaactggcttcgaggccggcacggaattgactgatgtcatctcctgcaagaccgtgactgcgggggacagcggggcggtcgacgtgcccttgtcgggcggactgccaagcgtgctctatcccagctcccagctggccaagagtggtctgtgtgcgtcggcgtga

SEQ ID NO: 14 - protein, 441 aa, Thermomyces lanuginosus
KYCGGTWRGIINNLDYIQDMGFTAIWITPVTAQWDDDVDAADATSYHGYWQKDLYSLNSKFGTADDLKALADTLHARGMLLMVDVVANHFGYGGSHSEVDYSIFNPLNSQDYFHPFCLIEDYDNQEEVEQCWLADTPTTLPDVDTTNPQVRTFFNDWIKSLVANYSIDGLRVDTVKHVEKDFWPDFNEAAGVYAVGEVFNGDPAYTCPYQEVLDGVLNYPIYYPALDAFKSVGGNLGGLAQAITTVQESCKDSNLLGNFLENHDIARFASYTDDLALAKNGLAFIILSDGIPIIYAGQEQHYAGDHDPTNREAVWLSGYNTDAELYQFIKKANGIRNLAISQNPEFTSSKTKVIYQDDSTLAINRGGVVTVLSNEGASGGDRTVSIPGTGFEAGTELTDVISCKTVTAGDSGAVDVPLSGGLPSVLYPSSQLAKSGLCASA

SEQ ID NO: 15 - DNA, 1443 bp, Acremonium sp.
  CDS (1)..(1443)
gctgccgggctctcggctgccgagtggcggagccagtccatctaccaggttgtcaccgacaggttcgcccggaccgacctgtcgaccacggcgtcgtgcaacacggcagaccaagtctactgcggagggacatggcaggggctcatctccaagctggactacatccagggcatgggtttcaccgccgtatggatctcaccagtggtcaagcaggtggaaggcaattcccaggacgggtcggcctatcacggatactgggcgcaggatatctgggccttgaatccggcttttgggaccgaggaggatctcgctgcgcttgccgcggcgctgcatgcccgaggcatgtacctcatggttgacattgtcaccaaccacatggcatacatgggctgcggcacctgtgtagactacagcctgttcaaccccttctcatcgtcatcgtacttccacccatattgcgccatcgactacagcaaccagacgtcggtcgaggtttgctggcaaggggataacattgtcagtctgcctgacctgcgcaccgaggatgacacggtgcgcagcatctggaaccgctgggttagccagctcgtgtccaactactccatcgacggcttccgagtcgacagcgcaaaacacgtcgagacgtccttttggcaagacttctcgacagcggcgggcgtgtacctgctgggcgaggtctttgacggggacccgtcgtacgtggcgccttaccagaactacctcaacggggttctggattatcccagctactactggatcctccgggctttccagtcatccagcggcagcatcagcgacctcgtctccgggctcaacacgctccatggcgttgctctggacctgagtctatatgggtccttcctcgagaaccacgatgtggcgcggtttgcgtccttcacgcaggacatgtccctagcgaagaatgccatcgcattcacaatgctgaaagacggcatccccatcatataccagggacaagagcaacattacgctggcggaacgacgcccaacaaccgcgaggcgctctggctctcgggctactcgactagctccgagctctacaagtggattgccgccttgaaccagatccgggcccgagctattgctcaagatagcggctacctctcctacagcagccaagccatctactcggacagccataccattgccatgcgcaaaggtacctcgggataccagatcgtgggcgtgttcaccaatgtcggggcctcgtcgtcggctacggtcaccctaacctcttccgcaacgggcttcggggcgaaccaagcactcgtcgacgtgatgagctgcaccgcttacaccacagattcgacgggagccctcacggtaaccctgaacgacggcctgcccaaggtgctttatccgattgcgcggctctcgggcagcggtatctgcccagggcag

SEQ ID NO: 16 - protein, 481 aa, Acremonium sp.
AAGLSAAEWRSQSIYQVVTDRFARTDLSTTASCNTADQVYCGGTWQGLISKLDYIQGMGFTAVWISPVVKQVEGNSQDGSAYHGYWAQDIWALNPAFGTEEDLAALAAALHARGMYLMVDIVTNHMAYMGCGTCVDYSLFNPFSSSSYFHPYCAIDYSNQTSVEVCWQGDNIVSLPDLRTEDDTVRSIWNRWVSQLVSNYSIDGFRVDSAKHVETSFWQDFSTAAGVYLLGEVFDGDPSYVAPYQNYLNGVLDYPSYYWILRAFQSSSGSISDLVSGLNTLHGVALDLSLYGSFLENHDVARFASFTQDMSLAKNAIAFTMLKDGIPIIYQGQEQHYAGGTTPNNREALWLSGYSTSSELYKWIAALNQIRARAIAQDSGYLSYSSQAIYSDSHTIAMRKGTSGYQIVGVFTNVGASSSATVTLTSSATGFGANQALVDVMSCTAYTTDSTGALTVTLNDGLPKVLYPIARLSGSGICPGQ

SEQ ID NO: 17 - DNA, 1413 bp, Malbranchea sp.
  CDS (1)..(1413)
gccacgcctgatgagtggcgctcaaggtccatctatcaggtcctgaccgaccggttcgcccgcggggatggctcgaccgatgccccgtgcgatacgggtgccaggaagtattgcggaggaaactatcggggactcatcagccagctcgactatatccagggcatgggattcgacagcgtctggatatcccccatcaccaagcagtttgaggatgactggaacggtgccccgtaccacgggtactggcagacggacctctatgcgctgaacgagcactttggtaccgaggaggatctccgagctctcgccgatgagctccacgcccgtggcatgttcctcatggtcgacgtcgtcatcaaccacaacggctggcccggcgacgcagcgtccatcgactactcgcagttcaacccgttcaacagctccgactattaccatccaccctgtgagatcaactatgacgaccagacttcggtcgagcagtgctggctctacaccggggccaatgcgctgcctgatctcaagacggaggacccccatgtctcgcaggtgcacaacgactggatcgccgacctcgtctccaagtattccatcgacggcttgcgcattgacaccacaaagcatgtggacaaacccgctatcggttccttcaatgacgccgctggcgtgtacgccgtcggagaggtttaccacggtgatcctgcatacacttgtccctaccaggactgggtcgacggggtcctcaacttccctgtctactacccgctaatcgacgcgttcaagtcgccttcgggcaccatgtggtctcttgtcgacaacatcaacaaagtcttccaaacctgcaatgacccgcggctcctggggaccttctcggagaaccatgacatcccccgcttcgcctcgtacacgcaagacctcgccctcgcgaagaacgtgctggccttcacgatcctgttcgacggcatcccaatcgtctacgcgggccaggagcaacagtactctggagactcggacccgtataatcgagaggccctctggctctccggattcaacaccgacgctcctctatacaagcacattgcagcttgcaacagaatacggtcgcacgcagtgtccaacgacgacgcgtacatcaccactccgacggacatcaagtacagcgatgaccacaccctggcgctggtcaagggtgcggtgacgaccgtgctgaccaacgccggcgccaacgccggcgagaccaccgtaacggtggaagcaaccggctatgccagtggagagcaggttactgatgtgctgagctgcgagtcgatcgctgcgtcggatggcggacgtctcagtgtaacactgaaccagggccttccacgtgtgttcttcccgactgatgcccttgcgggctccgggctctgcgagaac

SEQ ID NO: 18 - protein, 471 aa, Malbranchea sp.
ATPDEWRSRSIYQVLTDRFARGDGSTDAPCDTGARKYCGGNYRGLISQLDYIQGMGFDSVWISPITKQFEDDWNGAPYHGYWQTDLYALNEHFGTEEDLRALADELHARGMFLMVDVVINHNGWPGDAASIDYSQFNPFNSSDYYHPPCEINYDDQTSVEQCWLYTGANALPDLKTEDPHVSQVHNDWIADLVSKYSIDGLRIDTTKHVDKPAIGSFNDAAGVYAVGEVYHGDPAYTCPYQDWVDGVLNFPVYYPLIDAFKSPSGTMWSLVDNINKVFQTCNDPRLLGTFSENHDIPRFASYTQDLALAKNVLAFTILFDGIPIVYAGQEQQYSGDSDPYNREALWLSGFNTDAPLYKHIAACNRIRSHAVSNDDAYITTPTDIKYSDDHTLALVKGAVTTVLTNAGANAGETTVTVEATGYASGEQVTDVLSCESIAASDGGRLSVTLNQGLPRVFFPTDALAGSGLCEN

SEQ ID NO: 19 - DNA, 1350 bp, Rhizomucor pusillus
  CDS (1)..(1350)
agccctttgccccaacagcagcgatatggcaaaagagcaacttcggatgactggaaaggcaaggccatttatcagctgcttacagatcgatttggccgcgccgatgactcaacaagcaactgctctaatttatccaactactgtggtggtacctacgaaggcattacgaagcatcttgactacatttccggtatgggctttgatgctatctggatatcgccaattcccaagaactcggatggaggctaccacggctactgggctacagatttctaccaactaaacagcaactttggtgatgaatcccagctcaaagcgctcatccaggctgcccatgaacgtgacatgtatgttatgcttgatgtcgtagccaatcatgcaggtcccaccagcaatggctactcgggttacacattcggcgatgcaagtttatatcatcctaaatgcaccatagattacaatgatcagacgtctattgagcaatgctgggttgctgacgagttgcctgatattgacactgaaaattctgacaacgtggccattctcaacgacatcgtctccggctgggtgggtaactatagctttgacggcatccgcattgatactgtcaagcatattcgcaaggacttttggacaggctacgcagaagctgccggcgtattcgcaactggagaggtcttcaatggtgatccggcctacgttggaccttatcaaaagtacctgccatctctcatcaattacccaatgtattacgctttgaacgacgtctttgtatccaaaagcaaaggattcagccgcatcagcgaaatgctaggatcaaatcgcaatgcgtttgaggataccagcgtacttacaacgtttgtagacaaccatgacaatccgcgcttcttgaacagtcaaagcgacaaggctctcttcaagaacgctctcacatacgtactgctaggtgaaggcatcccaattgtgtattatggttctgagcaaggtttcagcggaggagcggatcctgctaaccgtgaagtgctgtggaccaccaattatgatacatccagcgatctctaccaatttatcaagacagtcaacagtgtccgcatgaaaagcaacaaggccgtctacatggatatttatgttggcgacaatgcttacgccttcaagcacggcgatgctttggttgttctcaataactatggatcaggttccacaaaccaagtcagcttcagcgttagtggcaagttcgatagcggcgcaagcctcatggatattgtcagtaacattaccaccacggtgtcctcggatggaacagtcactttcaaccttaaagatggacttccggctatcttcacctctgct

SEQ ID NO: 20 - protein, 450 aa, Rhizomucor pusillus
SPLPQQQRYGKRATSDDWKGKAIYQLLTDRFGRADDSTSNCSNLSNYCGGTYEGITKHLDYISGMGFDAIWISPIPKNSDGGYHGYWATDFYQLNSNFGDESQLKALIQAAHERDMYVMLDVVANHAGPTSNGYSGYTFGDASLYHPKCTIDYNDQTSIEQCWVADELPDIDTENSDNVAILNDIVSGWVGNYSFDGIRIDTVKHIRKDFWTGYAEAAGVFATGEVFNGDPAYVGPYQKYLPSLINYPMYYALNDVFVSKSKGFSRISEMLGSNRNAFEDTSVLTTFVDNHDNPRFLNSQSDKALFKNALTYVLLGEGIPIVYYGSEQGFSGGADPANREVLWTTNYDTSSDLYQFIKTVNSVRMKSNKAVYMDIYVGDNAYAFKHGDALVVLNNYGSGSTNQVSFSVSGKFDSGASLMDIVSNITTTVSSDGTVTFNLKDGLPAIFTSA

SEQ ID NO: 21 - DNA, 1338 bp, Dichotomocladium hesseltinei
  CDS (1)..(1338)
caaccggtgaacatcacgaagcgagcttctgctgctgactggcgctcgcgtgccatctaccaagtcctgaccgaccgctttgcgcgtaccgatgggtccacaagcggatgctcaaacttgtcaaattattgcggtggcacgttcaaaggcattaccaacaagcttgactacattgccaacctgggctttgacgctatctggatctcacccatcccaacaaactcgcccggcggctaccatggctactgggccaccgacttttatggtatcaatagcaactttggatcctcgaacgatctcaaggagcttgtcaatgctgctcacgccaagggtatgtacgtcatgctcgatgtcgtggcaaaccacgctggtccaacctcgaacggcgactactctggctacacgttcggttcctctggcctctaccataaccggtgctcgatcaactacaacgaccagagatccattgagcagtgctgggtggccgacgatctccctgatattaacaccgagaacaacgacaacgtcaacaagcccaataacattgtgtccacctgggtcaagacatatggctttgatgctatccgcattgacaccgtcaagcatgtccgcaaggatttctggcctggttatacatctgctgcaggcgtgttcgccactggcgaggtctttgatggtaacccgagttatgtggccgattatcaaaactacatggagtcgctcatcaactacccgctctactacgcgctcaatgacgtctttgcgtcgggttatagcttcagccggctgagcaaccagcgtgtcgcaaactaccacgccttcaaagacgtgagcgtccttcccatttttatcgacaaccacgacaacccccgcttcctcaacaaaaagaatgacatcgcccagttcaagaacgctctgacctacgtgcttctcggtgagggcatccctgtcgtctactacggctccgagcaagcttacgcgggtggtgccgacccggccaaccgcgaggccctctggtcgagcgggttctcgaccaactcggacatgtaccagttcattgccaaactcaatcgcgtccgtcaaaagagcaacaagagcgtgtacatggacctggacgtccagaacaatgtgtacgccttcatgcacggcaaatcgctcgttgtgctcaacaactttggtaacggtgcctcgagacaggttactgtcaatgtcggagctcaggtggccagcaacacccgattgacggatgttgtcagcggcacatcggtcacggtttcgggcagctctgtcaccttcactatcaacaacggtttgcccgcagtcttcactgtttcttag

SEQ ID NO: 22 - protein, 445 aa, Dichotomocladium hesseltinei
QPVNITKRASAADWRSRAIYQVLTDRFARTDGSTSGCSNLSNYCGGTFKGITNKLDYIANLGFDAIWISPIPTNSPGGYHGYWATDFYGINSNFGSSNDLKELVNAAHAKGMYVMLDVVANHAGPTSNGDYSGYTFGSSGLYHNRCSINYNDQRSIEQCWVADDLPDINTENNDNVNKPNNIVSTWVKTYGFDAIRIDTVKHVRKDFWPGYTSAAGVFATGEVFDGNPSYVADYQNYMESLINYPLYYALNDVFASGYSFSRLSNQRVANYHAFKDVSVLPIFIDNHDNPRFLNKKNDIAQFKNALTYVLLGEGIPVVYYGSEQAYAGGADPANREALWSSGFSTNSDMYQFIAKLNRVRQKSNKSVYMDLDVQNNVYAFMHGKSLVVLNNFGNGASRQVTVNVGAQVASNTRLTDVVSGTSVTVSGSSVTFTINNGLPAVFTVS

SEQ ID NO: 23 - DNA, 1398 bp, Meripilus giganteus
  CDS (1)..(1398)
cgccctactgtctttgacgccggcgcggacgcacactcgctgcatgcccgggccccctccggcagcaaggatgtcatcatccagatgtttgagtggaactgggacagcgtcgctgccgagtgcactaacttcatcggccccgccgggtacggcttcgtgcaagtgagcccgccccaggagaccatccagggcgcgcagtggtggaccgactaccagccggtgtcgtacacgctcactgggaagcggggcgaccgctcccagtttgcgaacatgattactacgtgccacgccgcgggcgtcggcgtgatcgttgacaccatctggaaccacatggcgggcgtcgactccggcacgggtaccgccggctcgtccttcacgcactacaactaccccggcatctaccaaaaccaggactttcaccactgcggcctcgagccgggcgatgacatcgtcaactacgacaacgcggttgaggtccagacctgcgagcttgtcaacctcgctgacctcgccaccgacacggagtatgtgcgcggtcgccttgcccagtacggaaacgacctgctctcgctcggtgccgatggcctgcgtcttgacgcttccaaacacattcctgtgggcgacatcgcgaacatcctgtctcgcctcagtcgctctgtctacatcacccaggaagtcatctttggggccggcgagcccatcacgccgaaccagtacaccgggaacggcgacgttcaggagttccgctacacctctgcgctaaaggacgccttcttgagctcgggcatatccaacctgcaggacttcgaaaaccgtggatgggtacctggctcgggcgccaacgtgttcgtcgtcaaccatgacaccgagcggaacggcgcgtcgctgaacaacaactcgccttcgaacacctacgtcaccgcgacgatcttctcgctcgcacacccgtacggcacgcccacgatcctctcctcgtatgatggcttcacgaacaccgacgccggtgcgccgaacaacaacgtcggcacatgctcgaccagcggtggtgcgaacgggtggctctgccagcaccgctggaccgcgatcgccggcatggtcggcttccgcaacaacgtcggcagcgctgcactcaacaactggcaggccccgcagtcgcagcagattgcgttcggtcgcggcgcacttggcttcgtcgcgatcaacaacgccgactcggcctggtctacgacgttcaccacttccctccccgatggttcctactgcgatgtcatcagcggcaaggcctccggcagtagctgcaccggttcttcgttcaccgtctccggcgggaagctgaccgccacggtgccggcgcgtagcgccatcgccgtgcacaccggtcagaaaggttctggtggt

SEQ ID NO: 24 - protein, 466 aa, Meripilus giganteus
RPTVFDAGADAHSLHARAPSGSKDVIIQMFEWNWDSVAAECTNFIGPAGYGFVQVSPPQETIQGAQWWTDYQPVSYTLTGKRGDRSQFANMITTCHAAGVGVIVDTIWNHMAGVDSGTGTAGSSFTHYNYPGIYQNQDFHHCGLEPGDDIVNYDNAVEVQTCELVNLADLATDTEYVRGRLAQYGNDLLSLGADGLRLDASKHIPVGDIANILSRLSRSVYITQEVIFGAGEPITPNQYTGNGDVQEFRYTSALKDAFLSSGISNLQDFENRGWVPGSGANVFVVNHDTERNGASLNNNSPSNTYVTATIFSLAHPYGTPTILSSYDGFTNTDAGAPNNNVGTCSTSGGANGWLCQHRWTAIAGMVGFRNNVGSAALNNWQAPQSQQIAFGRGALGFVAINNADSAWSTTFTTSLPDGSYCDVISGKASGSSCTGSSFTVSGGKLTATVPARSAIAVHTGQKGSGG

SEQ ID NO: 25 - DNA, 1494 bp, Stereum sp.
  CDS (1)..(1494)
gatgattggaagaaccgtactatctatcagctcgtgacggaccgcttcgcgctagccaatgattccagcggttcatgcgacacttcagaccgtgtttactgtggaggatcatggcaaggtgttatcaaccacctcgattacatccaaaacatgggcttcgacgccgtctggatttctcccgtcagcaccaactttgaaggctcgagtgcttatggcgaggccttccatggttactggccctctgacctttcatctgtcaactctcacttcggttctgatgacgacctcaagagccttgcatcagcccttcatgatcgctcaatgtacctcatgattgatgtcgtcgtcaatcacctcgtctacccctccaaccctcccaccttcagtgacttcaaccctttcaacaccgagtccgacttccatcccgagtgcttcatcaccgactataataaccaaactgatgttgagcagtgctggctcggtgattcaaacttgcctctggcagataccaacacggaggatgatgataacgtctcgagcttgtacagctggattaagaaccttgtcagcacgtacagcgctgacggtatccgtatcgacaccgtgaagcacatccgtcaggacttctggcccgactttgctagctctgctggagtctacaccattggagaggttctgagcaacgacaccgcctacatcgccaactacacgcaagtccttgacggtgttctcgattactctacctggtatcctctcgtggctggcttccagtcgacctccggaaacctttccgctatcaaggccacctatagccaagtctccagctcgttcaagaacggcgggttccaatcaggctctttcctcgaaaaccatgaccagccccgtttccagagcatgaccacggatcagtctctcgtcaagaacgcgatgacctggcccttcatcaacgatggtattcccattctgtactacggacaagagcaaggctactctggtggcgctgaccccgctaaccgtgaggccctttggtcgtccggctacgaagaggataaggatctcgttacccacgtgaagacgctcgttgccgcccgcaagctcgctgctgccgctaacagcaacttccacagtaccgctgccacgttccccacgactagcgacgaatccaccctggccgtcctcaaaaccccaatgcttgccctcctcactaacaccggctcatccggctctgcatccttctcgacttcaggcgccggcttttccgctaacgaggcgctcgttgatgtcctcacttgcaacaccgtcaccgctgactcgtccggtgaggtcgggctcgcgtctaagtcgggcctgccgcaggtgttattgcccgtcagtgcgctgacgtcggccggtggcgtgtgcacgaacttggtgagcgcggcgcatgtcagcgcgagagtgccgagtgcgatggtggcgacgacggtgttgtttgcgctcttccgattcctggcg

SEQ ID NO: 26 - protein, 498 aa, Stereum sp.
DDWKNRTIYQLVTDRFALANDSSGSCDTSDRVYCGGSWQGVINHLDYIQNMGFDAVWISPVSTNFEGSSAYGEAFHGYWPSDLSSVNSHFGSDDDLKSLASALHDRSMYLMIDVVVNHLVYPSNPPTFSDFNPFNTESDFHPECFITDYNNQTDVEQCWLGDSNLPLADTNTEDDDNVSSLYSWIKNLVSTYSADGIRIDTVKHIRQDFWPDFASSAGVYTIGEVLSNDTAYIANYTQVLDGVLDYSTWYPLVAGFQSTSGNLSAIKATYSQVSSSFKNGGFQSGSFLENHDQPRFQSMTTDQSLVKNAMTWPFINDGIPILYYGQEQGYSGGADPANREALWSSGYEEDKDLVTHVKTLVAARKLAAAANSNFHSTAATFPTTSDESTLAVLKTPMLALLTNTGSSGSASFSTSGAGFSANEALVDVLTCNTVTADSSGEVGLASKSGLPQVLLPVSALTSAGGVCTNLVSAAHVSARVPSAMVATTVLFALFRFLA

SEQ ID NO: 27 - DNA, 1539 bp, Trametes sp.
  CDS (1)..(1539)
gcgagcgcagaccagtggcagaaccggtctatctaccagttggtaacagatcgttttgcaacccctgacggctctagcccgtcatgcgacacttcgcaacgccagtattgtggtggcacctggaaaggcgtggcaaacaaactcgactacattcagaacatgggctttgacgcgatctggatctccccgatcgtcgcaaacgtcgaggggaacacctcatatggcgaagcattccatggatactggacacaagacatcaactcgctcaactctcatttcggttccgccgacgatctcaaagccctcagctcagccttgcatgatcgaggcatgtacctcatggtcgacgtcgttgtaaaccacatggttggcacctccgacccgcccaacttctcttccttccagccgttctcgtcacagtccgacttccactccgagtgctttgtgtcgaactacgacaaccagaccgaagtcgaacagtgctggctaggcgacaagaacgtccccttggtagacttgaacaccgaggatgcggacatcgtaaagaccatgaacacatggatctctacgctcgttggtaactacagcgtcgacggtgtccgtatcgacactgtcaagcacgtccggaaagacttctggcccgacttcgccaagtctgctggcgtcttcaccattggcgaggtcctccacaatgagacggattacgtctcggcatacactcaggtcctcgacagcgtcctcgactaccccacctggttcccgcttgtggctgctttccagactacgggtggcaatctgtcagctcttgctgcgaccgttcaacaggcgcaaggctcttataagaagggcgagttcatgacgggttccttccttgagaaccacgatcagcctcgattccaatccctcacgcaagatcaggcgttggtaaagaacgccatgacttggccattcgttcaagatggtgtcccgattatgtactacggccaagaacagtcctacgctggaggacctgacccggccaaccgtgaagctttgtggctctccggctatgtcgaagataagcccctggtcaagcatgttagggcactaaacgcagcccgcaaagctgcgatctcggcgaacagtaactatctgaacaccggcgtcaaatttttgtccaccggatccgaatcctccatggccgtgtctaagccgcccatgctggctctcctcacgaacggcggcagctcgtcaacgccttcgtggaccgtctcagatgctgggtaccaagccaacgaggagctgatcgacgtgctcagttgccagaaggtcaccgccgacggaaacggcggggtgagcgtgcagggatccagcggcagccctcaagtcctcatgccgacgtctgcgctcaacaagtctggaagcatctgtgcagaagacgcgacgggaggccaagcctcggctgcgcaaggctggatcgaacgtgcggcagagtctctgccaatcgctgctgcgctgttgctcgcgggatgggctgcgcagtccagccttgttatcctg

SEQ ID NO: 28 - protein, 513 aa, Trametes sp.
ASADQWQNRSIYQLVTDRFATPDGSSPSCDTSQRQYCGGTWKGVANKLDYIQNMGFDAIWISPIVANVEGNTSYGEAFHGYWTQDINSLNSHFGSADDLKALSSALHDRGMYLMVDVVVNHMVGTSDPPNFSSFQPFSSQSDFHSECFVSNYDNQTEVEQCWLGDKNVPLVDLNTEDADIVKTMNTWISTLVGNYSVDGVRIDTVKHVRKDFWPDFAKSAGVFTIGEVLHNETDYVSAYTQVLDSVLDYPTWFPLVAAFQTTGGNLSALAATVQQAQGSYKKGEFMTGSFLENHDQPRFQSLTQDQALVKNAMTWPFVQDGVPIMYYGQEQSYAGGPDPANREALWLSGYVEDKPLVKHVRALNAARKAAISANSNYLNTGVKFLSTGSESSMAVSKPPMLALLTNGGSSSTPSWTVSDAGYQANEELIDVLSCQKVTADGNGGVSVQGSSGSPQVLMPTSALNKSGSICAEDATGGQASAAQGWIERAAESLPIAAALLLAGWAAQSSLVIL

SEQ ID NO: 29 - DNA, 1521 bp, Coriolus censor
  CDS (1)..(1521)
gcctctcctgacgactggcgtactaggtcgatctaccagcttgtgaccgacagatttgcaacccctgatggctcaagcccaacatgtaacaccgaggaccgaaggtactgcggtggtaactacaagggtatcatcaacaagctcgactacattcaaaacatggggtttgacgccatctggatctcacctgtggtcgcgaatgtagagggaaataccagtctcggtgaagccttccatggctactggactcaagatatcaacaaattgaacgatcatttcgggtctactgacgatttgaagtcgctttcggatgccctgcacaagcgtaacatgtatctgatggtcgatgtggttgtcaaccatatggcggcaacgtcaaacccaccgaactttggcagtttcgcgcccttcaatcaacagtccaacttccacccggaatgttttatccaagcctcggactacgacaacaatcagaccgctgtcgaacaatgctggcttggcgacgaaaatctcccactcgcggatatgaataccgaggaccaaaacgtgatcagcacatggaacacatggatcggcgacttggtcaagaactatactatcgatggtgtccgcattgatactgtcaagcatgtgcgaaaggacttctggcccgactttgccaaggccgctggcgtatacactattggtgaagttttgcacaacgataccaactatgttgcaccctacacgcaggcgctttctgctgcactagactatcctgcctacttcttcttgactgctggtttccaaacctccaacggcaacttatcgaattttgcttcggttatccaggccgggcagggtgcatacaacaatggcgagcactacatgggctccttccttgagaatcacgacaaccctcgtttccaatccctcactcaagatcaagcattggtaaagaatgcgatgacttggccatttatccaagacggtatcccgatcctttactacggtcaggaacaaggctacgccggtggaaatgatcctgctaaccgtgaagcactctggctgtccgggtacggcgaagacaaacccctggttcagcatgtcaagacgttgaacgccgcgcgtaaggccgctgccgctgccaaaagcgacttccacaccagcagcctccaattccttgtcagcacacagaacaatctggccatttcgaagccccctatgcttacgctgctcactaatgaaggtagcacttctacgccacaatggagcgtcccaaacgctgggttcagcgcaaacgaggaagtcgtcgatgtgttgacttgcacgaagataaacgctgacgctaacggaggtgtcactgtcaaaggctcgggaggtaatccccaagtcctgatgcctacttctgcccttccaaaaggcgggaccgtatgtcccgacttagcaacgggagcacagtcttcctctgctcgttcactcgcggtgcaggtgcttgggacttctctcgctgccgttctcactctcgccattgcattctcg

SEQ ID NO: 30 - protein, 507 aa, Coriolus censor
ASPDDWRTRSIYQLVTDRFATPDGSSPTCNTEDRRYCGGNYKGIINKLDYIQNMGFDAIWISPVVANVEGNTSLGEAFHGYWTQDINKLNDHFGSTDDLKSLSDALHKRNMYLMVDVVVNHMAATSNPPNFGSFAPFNQQSNFHPECFIQASDYDNNQTAVEQCWLGDENLPLADMNTEDQNVISTWNTWIGDLVKNYTIDGVRIDTVKHVRKDFWPDFAKAAGVYTIGEVLHNDTNYVAPYTQALSAALDYPAYFFLTAGFQTSNGNLSNFASVIQAGQGAYNNGEHYMGSFLENHDNPRFQSLTQDQALVKNAMTWPFIQDGIPILYYGQEQGYAGGNDPANREALWLSGYGEDKPLVQHVKTLNAARKAAAAAKSDFHTSSLQFLVSTQNNLAISKPPMLTLLTNEGSTSTPQWSVPNAGFSANEEVVDVLTCTKINADANGGVTVKGSGGNPQVLMPTSALPKGGTVCPDLATGAQSSSARSLAVQVLGTSLAAVLTLAIAFS

SEQ ID NO: 31 - DNA, 1443 bp, Dinemasporium sp.
  CDS (1)..(1443)
gccacggcagagcaatggaggtcgcgggcgatatatcagcttctcactgatcgattcgcaagaccagataatagcacgacagcaacatgttatacaccagatagaaactactgtggaggaacttggagtggcatcatcagccaattagattacatccaggacatgggcttcaccgcgatatggatatctcccgtaacttcgaacattcctaatataacttcttacggctacgcttatcacggatactggcaacaagacctttataagttgaatgatcattttggcactgccgaagatttgaaagcactcagccaggcattgcatgacagagacatgtatctgatggtagatgtagtcgcaaaccataacggctggcccggcgattctgcctcagtaaattactccgcgttctacccgttcgacaatgcatcacactatcatttgttctgcgtcgtcgacgattatagcaatcagaccgacgtcgaggactgttggctcggggatacgaatgtcgagctggtggatttagacacgaacagtcaagatgttgttgatgggtactctaaatggattggtgaattggtctcgaactactccatcgacggtctccgcatcgacacggtaaagcacgtcgacaagcccttctggacttctttccaacaagcagccggcgtcttcacgacaggggaaatactctcgggtgatccttcctatacttgcgactaccagaattatcttgatagtacattgaactacccgttatggtggccagcaatggcgttcctcaactcaacatctggctcctccgccaacctcctcaacctactgagctccctacggtctacttgcaaagacgtctccgtcctcggtgtattcaccgagaaccacgacctccctcgcttcgcctcgcaaactcaagacatggctttagccaagaacgctctcgccctcacgatcttgtctgacggcatacccatagtctacgcaggacaagaacaacactacgacggatcgggcgatccctacaacagagaggcaaattggctctcgggctactcgcgctcgaacgaactgtacctcctcgtcgccgccgtcaaccaagtccgcaacagagccttgtatcgagatgcaaactacgcgacttataatgctacctctatctatagtgatcaacatactgttgcgttccgcaaagggtacgatggacaccagatcatctccgtcatcaccaataccgggacctctactcctctatggaacctcacggtgccggacacaggtctggcatctggcactgctgttgtagagattataacgtgcgatcagtctgtcattgcgagtgatgggagtctagctgtgccgatggaaggagggatgccgaggatatattatccggtggatgaggcggttggtagtgggatttgtaatcttacgagtagctat

SEQ ID NO: 32 - protein, 481 aa, Dinemasporium sp.
ATAEQWRSRAIYQLLTDRFARPDNSTTATCYTPDRNYCGGTWSGIISQLDYIQDMGFTAIWISPVTSNIPNITSYGYAYHGYWQQDLYKLNDHFGTAEDLKALSQALHDRDMYLMVDVVANHNGWPGDSASVNYSAFYPFDNASHYHLFCVVDDYSNQTDVEDCWLGDTNVELVDLDTNSQDVVDGYSKWIGELVSNYSIDGLRIDTVKHVDKPFWTSFQQAAGVFTTGEILSGDPSYTCDYQNYLDSTLNYPLWWPAMAFLNSTSGSSANLLNLLSSLRSTCKDVSVLGVFTENHDLPRFASQTQDMALAKNALALTILSDGIPIVYAGQEQHYDGSGDPYNREANWLSGYSRSNELYLLVAAVNQVRNRALYRDANYATYNATSIYSDQHTVAFRKGYDGHQIISVITNTGTSTPLWNLTVPDTGLASGTAVVEIITCDQSVIASDGSLAVPMEGGMPRIYYPVDEAVGSGICNLTSSY

SEQ ID NO: 33 - DNA, 1485 bp, Cryptosporiopsis sp.
  CDS (1)..(1485)
ttggacgcagcaggatggcgaaaccagagcatctaccaggtcctgacggaccgcttcgccatggccgacggctcgacacccgcatgcgacgcatcccaaggcctctactgcggtggcacctggcagggcatcaccaaccagttggattacatccagaacctgggtgccaccgccgtctggatctcccctgtcatcaagaacgtcgagggcaactttgccgattccggcgaggcctaccacggcttctgggcgcaagacctctactcgctcaactcgcatttcggtaccgaggccgacctcaaggccctcgccgacgcgctccacgcccggggcatgtacctgatggtcgacatcgccccgaaccacgtgggcctgaatacggatgccaacaactataccggttacactcccttcaacgagaccgaatactaccacgacgagtgcagcatcgtctggaacgtccctacgtccgagaggctctgctggctcgagggtctgcccgacctgcgtaccgaagatgccggcgtacgccaggtgtatgcggaatggatcaaggacctggttgccaattactccatcgacggtctccgtatcgataccgccctggagatcgagccggagttctggaccgacggtggtgtccgcgaggccgccggcgtcttcctcctggccgagattaaccacagcaacccggagaccctggcgccctaccagcagtacctcgacgggtacatggactacagcagctggaactggatcacggattcgttccaggccgtcgacgccagcatgaccgacctctacgaggggaccaaccagctggcggccatgaccgacatcgacccgtcgctcttcggctcctttgtcgagaaccacgaccaggtccggttcccctaccgcaacgccgacatggccctggccaagaacctgtacaccctcgccctgctccgggacgggatccccatcgtctactacggacaggagcagcactttgacggcggcatcgtgcccagcaaccgggaggcgctctggctcggcacctacgacatctacgccgagctgtacggctggatccagcagaccatcaaggcgcgcgcgcacgccgcggcggcggacgccaccttcctcacgacgcagaggacacaggccatcttctaccagaacgccaccgacatcaacagcagcgtcatcggcttccgcaagggccagatgctcaccatgtacaccaacggtggcgccgatgccctcaacggtgcctactttgccattgcccgcaacgtgcacggctacgccatcggtgaggacctggtcgacgtggtgaactgcgaatcgttccaggtcgccccccacggacggctctgggtccagatgcccaacggtggtctgccgcgtgtgtttttaccggtgaatcagaccgaggggctctgcaacaacgtcggcacgcctttgtctaactctaccatcactgttgcgattgacaaggca

SEQ ID NO: 34 - protein, 495 aa, Cryptosporiopsis sp.
LDAAGWRNQSIYQVLTDRFAMADGSTPACDASQGLYCGGTWQGITNQLDYIQNLGATAVWISPVIKNVEGNFADSGEAYHGFWAQDLYSLNSHFGTEADLKALADALHARGMYLMVDIAPNHVGLNTDANNYTGYTPFNETEYYHDECSIVWNVPTSERLCWLEGLPDLRTEDAGVRQVYAEWIKDLVANYSIDGLRIDTALEIEPEFWTDGGVREAAGVFLLAEINHSNPETLAPYQQYLDGYMDYSSWNWITDSFQAVDASMTDLYEGTNQLAAMTDIDPSLFGSFVENHDQVRFPYRNADMALAKNLYTLALLRDGIPIVYYGQEQHFDGGIVPSNREALWLGTYDIYAELYGWIQQTIKARAHAAAADATFLTTQRTQAIFYQNATDINSSVIGFRKGQMLTMYTNGGADALNGAYFAIARNVHGYAIGEDLVDVVNCESFQVAPHGRLWVQMPNGGLPRVFLPVNQTEGLCNNVGTPLSNSTITVAIDKA

SEQ ID NO: 35 - DNA, 1428 bp, Coniochaeta sp.
  CDS (1)..(1428)
gcagactggcgtgagcagtccatctaccaggtcgtgacggaccgcttcgcgcggacggacctgtccaccacggccacgtgcgacacctcggcgcaggtgtattgcggcggcacgtacaagggtctgatctccaagctggattacattcagggcatgggcttcactgccatctggatatcgcccatcgtcgagcagatggacggtaatactgccgacggctcctcgtatcacggttactgggcgcaggatatttggagtctgaacccgtcgttcggatcggctggcgacctgatcgcgctctccaacgcgctgcacgcccggggcatgtacctcatgctggacgtggtgaccaaccactttgcttacaacggctgcggcaactgcgtcgactacagcatcttcaccccgttcaactcgtcgtcgtacttccaccccttctgcttgatcgactacaacaaccagacgtcgatcgagcagtgctgggagggagacaacaccgtcagcctgccggacctgcggacggagaactccaacgtacgcgcgatatggaacgactggatcacgcagattgtggcggcgtacggcatcgacggtctgcgcatcgacagcgtcaagcaccaggagacgtcgttctggtccggtttcgggtcggccgccggcgtgttcatgctgggcgaggtgtacaacggcgatccgacgcagctggcgccgtaccaggattacatgcccggactgctggactacgcgagctactactggatcacgagggcgttccagtcgagcagcgggagtatgagcgatctggcgtctggtgtcaacacactcaagagcattgccaggaacacaagcctgtacggatctttcctggagaaccacgaccagccgcggttcgcgtcgcttacctcggacgtcgccttggcgaagaatgcgatagcgtttactatgctgaaggacggtatcccggtcgtttaccagggccaagagcagcactatgcgggcggaaatgtcccagctgaccgcgaagcgatctggttgtcggggtactccacgtctgcgacgctgtacacctggatcgccgcgctgaacaaggtccgttcgagggctatcgcgcaagacagcagctacctgagctatcaggcgtatcctgtctatacggacagcaacaccattgccatgcgcaagggacgggacggataccaggtcatcggggtgttcaccaacaagggatcgagcgggttgtccagtctcaccctcacgacgtcgatgaccggattcacggcgggccaggcggtcgtggatgtcatgagctgcaccactttcacgacggactacagcggtagcctcgctgtcaccctttcgggaggcattccgcgggtgttctatccaagcgcgaggttgagtggctcaggaatatgtggctccaatggg

SEQ ID NO: 36 - protein, 476 aa, Coniochaeta sp.
ADWREQSIYQVVTDRFARTDLSTTATCDTSAQVYCGGTYKGLISKLDYIQGMGFTAIWISPIVEQMDGNTADGSSYHGYWAQDIWSLNPSFGSAGDLIALSNALHARGMYLMLDVVTNHFAYNGCGNCVDYSIFTPFNSSSYFHPFCLIDYNNQTSIEQCWEGDNTVSLPDLRTENSNVRAIWNDWITQIVAAYGIDGLRIDSVKHQETSFWSGFGSAAGVFMLGEVYNGDPTQLAPYQDYMPGLLDYASYYWITRAFQSSSGSMSDLASGVNTLKSIARNTSLYGSFLENHDQPRFASLTSDVALAKNAIAFTMLKDGIPVVYQGQEQHYAGGNVPADREAIWLSGYSTSATLYTWIAALNKVRSRAIAQDSSYLSYQAYPVYTDSNTIAMRKGRDGYQVIGVFTNKGSSGLSSLTLTTSMTGFTAGQAVVDVMSCTTFTTDYSGSLAVTLSGGIPRVFYPSARLSGSGICGSNG

SEQ ID NO: 37 - DNA, 1431 bp, Diplodia sp.
  CDS (1)..(1431)
gctactcccgcccaatggcgctccaagtccatctaccaggtcctcactgataggtttgcccgcaccgatggcagcaccagcgcaacgtgcaacacgcaggacagaaagtactgcggcggaacgtaccagggaatcatcaaccaactggactacatacagggcatgggcttcactgccatttggatctcccccgtcgtcaagaatctgcccgagaccactggctatggagaggcctaccacggctactggcagcaggacctgtacagcctcaatgagaactttggatctgcagctgatctccaggctctcgctgccgagctgcatgaccgcgacatgtacttgatggtggatattgtcgtcaaccacaatggctgggctggctcgtcaagctctgtggactacagcaggttcaacccgttcaactcgcaggactactatcattcgtactgcaccgtctccgactacaacaaccaggacctcgtcgaggattgctggcttggtgacaacactgtccagctcgtcgacctcaagaccgaagactcggccgttgccgatggctacaacacctggatctcccaacttgttgcaaactactccattgacggtctgcggatcgacacggccaagcacgtggacaaggcattctaccctccctttgaggctgcggctggtgtcttctccaccggcgaagtctacgatggcaacccatcctacacttgtgactaccagaactatatggacagcgtgctcaactatcccgtatactacccgctagtccgggccttcacttcgaccagtggctccatctccgatcttgtgaacatggtcagcacgctcaagagcggctgcaaggacaccacgcttctcggcaccttctccgagaaccacgacatcacgcgcttcgccgccatcacgtccgacttctcgcaggccaagaacgtcatcgccttcaacatcctcgccgacggcatccctatcatctaccagggccaggagcaacactactcgggcgccgaggacccggacaaccgcgaggccgtctggctctcgggctacaacacgggcgccgagctgtacaccttcaccgccgccgtcaacgccatccgcaaccgcgccatcgccgacgacgccgactacctgacgtaccagaactgggtcatctacagcgacacgaccaccatcgctatgcgcaagggcttcgacggctaccagatcatcaccgtcttgagcaacaagggcgccaatggcgatgcgtacacgctcaatctgtccaacacgggctggacgagtggaaccgaggtcgtcgaggtgctgacgtgcagcagagtcacggtgacgagcagcgggacggtgacggtacccatgtcgaatggtctgccgagggtctactacccggctgcccggctgagcgggtcgggcatctgtgatcta

SEQ ID NO: 38 - protein, 477 aa, Diplodia sp.
ATPAQWRSKSIYQVLTDRFARTDGSTSATCNTQDRKYCGGTYQGIINQLDYIQGMGFTAIWISPVVKNLPETTGYGEAYHGYWQQDLYSLNENFGSAADLQALAAELHDRDMYLMVDIVVNHNGWAGSSSSVDYSRFNPFNSQDYYHSYCTVSDYNNQDLVEDCWLGDNTVQLVDLKTEDSAVADGYNTWISQLVANYSIDGLRIDTAKHVDKAFYPPFEAAAGVFSTGEVYDGNPSYTCDYQNYMDSVLNYPVYYPLVRAFTSTSGSISDLVNMVSTLKSGCKDTTLLGTFSENHDITRFAAITSDFSQAKNVIAFNILADGIPIIYQGQEQHYSGAEDPDNREAVWLSGYNTGAELYTFTAAVNAIRNRAIADDADYLTYQNWVIYSDTTTIAMRKGFDGYQIITVLSNKGANGDAYTLNLSNTGWTSGTEVVEVLTCSRVTVTSSGTVTVPMSNGLPRVYYPAARLSGSGICDL

SEQ ID NO: 39 - DNA, 1323 bp, Nectria sp.
  CDS (1)..(1323)
gccgacacccagtcatggaagtctcgcaacatctattttgccctgacagaccgcatcgccaagagcagctcggacactggcggcagtgcctgtggcaatcttggaaactactgtggtggcacgttccagggtctgcagtccaagcttgactacatcaagggcatgggctttgacgccatctggataacacccgtcgtggagaacactgatggtggctaccatggatactgggccaaggacctgtactctgtcaattccaagtacggaactgcggatgacttgaagagcttggtcagcgcagcgcatggcaagggcatctacatgatggttgacgttgttgccaaccacatgggtagtggcgacatcagcacatacaaccccccgccgctcaaccaagcgagcgcctaccacggctcgtgtgatatcaactacgacgaccagaacagcattgagcagtgcaggatttccggtcttccggatatcaacacggaggataactcagtgaaagcggccctgcacgaatgggtcggatggcttgtcaaggagtacaactttgacggtgtccgcatcgacacagtcaagcatgtgtcgaagagtttctggcctgattttgcctggtcctctggagtatacaccattggcgaggtcttcaatggcgaccccgattacctagccgaatatgacaacctcatgggaggtctcctcaactatgccgtctactaccccatgaaccggttctaccagcaggagggatcctcgaaggaccttgccagcatgatcgacacggttagtgccaaattctccgatccgacgaccctgggaacattcctcgacaaccatgacaaccctcgatggctcaacaagaagaacgacgtcactctgttcaagaacgccctggctttcgtcatcctcgctcgtggcattcccatcgtctactacggtagtgagcagggctacggcggtggtgctgatccgcagaaccgggaggacctttggcgaagcggcttcaacaccaactctgacctgtacggtgccatctcgcgcctctctgctgcgcgatcagcacatggtggcctccccaacaacgaccacgtccacctcaacaccgaagacggaatatacgcctggagccgagcgggcggcgatctcgtcgtcttcacttccaaccgcggctccagcctcaacggcgagtactgcttcactactgatcgttcaaatggatcgtggaacgatgtttttggcagcgggtcctatacttcggatggtaacggcagggtctgtgtcaatgtgaacaatggccagccggtggtcctgagtgctaaa

SEQ ID NO: 40 - protein, 441 aa, Nectria sp.
ADTQSWKSRNIYFALTDRIAKSSSDTGGSACGNLGNYCGGTFQGLQSKLDYIKGMGFDAIWITPVVENTDGGYHGYWAKDLYSVNSKYGTADDLKSLVSAAHGKGIYMMVDVVANHMGSGDISTYNPPPLNQASAYHGSCDINYDDQNSIEQCRISGLPDINTEDNSVKAALHEWVGWLVKEYNFDGVRIDTVKHVSKSFWPDFAWSSGVYTIGEVFNGDPDYLAEYDNLMGGLLNYAVYYPMNRFYQQEGSSKDLASMIDTVSAKFSDPTTLGTFLDNHDNPRWLNKKNDVTLFKNALAFVILARGIPIVYYGSEQGYGGGADPQNREDLWRSGFNTNSDLYGAISRLSAARSAHGGLPNNDHVHLNTEDGIYAWSRAGGDLVVFTSNRGSSLNGEYCFTTDRSNGSWNDVFGSGSYTSDGNGRVCVNVNNGQPVVLSAK

SEQ ID NO: 41 - DNA, 1347 bp, Gliocladium sp.
  CDS (1)..(1347)
gccgacactgccacatggaagtcccgcagaatttactttgcgctgacggaccgcattgcccggagcagcaccgacgccggtggaggctcgtgcagcgaccttggtagctactgcggtggcacgttccagggcctgcaggccaagctcgactacatccagggtctgggttttgacgctgtctggatcacgccagtcgtcgcgaacagcgatggcggctaccacggctactgggccgaggacctcttcgccattaaccccaagtacggatctgccgacgacctgaagagcctcgtcaatgcgagccacgaaaaaggcatgtttgttatggtcgacgtcgtcgccaaccatatgggccgcgccaacatcgccgacgacaagccctcgcccctcgatcaggagacgtcctaccacgcgccatgcaccatcgactactccaaccagacgagtgtcgagaactgccgcatcgccgccgatttgcccgatgtggacacgcatgacccggccattcggcagctctatcagtcgtgggtgcactggctcgtgtctgagttcagcttcgacggcgtgcgcattgacacggtcaagcacgtcgaaaaggacttctggccgccgtttgctaccgccgccggtgtctacaccatcggcgaggtcttccatggcgatccggcctacgtcgctagctacgcgggactcatgtcggggctgctcaactatgctgtctacttcccgctcacccgtttttaccagcagcgcggttcgtctcaggatctcgtcgatatgcacgatgcagtcagctccaagttccccgacccggccgccctgggcacctttctcgacaaccacgacaatccgcggtggctaggccagaacggcgacaccgtcctgctacgcaacgctttgacgtacgtactgcttgcgcggggggtccccatcctgtactacggcaccgagcaggggttctcaggtggtgccgacccggccaaccgggaggacctctggcgcagcggcttcgccactgacgggcctctctacaagttcatagccaccatggcgggtgtacgcaggtctgctggtgggctgccggataacgaccatgtgcatctttacgttgcgggtgatgcgtacgcgtggagccgcgccggcggtaaggtcatcgcactgacgagcaacggcgggagcggcaagtcgcagcgctactgcttcaactcacagaggcagaacggagcgtggaagggggccttagacggcaagacgtacgcgtcggatggaagagggcagctttgtgcggacgtgaccaagggggagcccgtcgtccttgtcgcttccaccgccatgccaggggaattg

SEQ ID NO: 42 - protein, 449 aa, Gliocladium sp.
ADTATWKSRRIYFALTDRIARSSTDAGGGSCSDLGSYCGGTFQGLQAKLDYIQGLGFDAVWITPVVANSDGGYHGYWAEDLFAINPKYGSADDLKSLVNASHEKGMFVMVDVVANHMGRANIADDKPSPLDQETSYHAPCTIDYSNQTSVENCRIAADLPDVDTHDPAIRQLYQSWVHWLVSEFSFDGVRIDTVKHVEKDFWPPFATAAGVYTIGEVFHGDPAYVASYAGLMSGLLNYAVYFPLTRFYQQRGSSQDLVDMHDAVSSKFPDPAALGTFLDNHDNPRWLGQNGDTVLLRNALTYVLLARGVPILYYGTEQGFSGGADPANREDLWRSGFATDGPLYKFIATMAGVRRSAGGLPDNDHVHLYVAGDAYAWSRAGGKVIALTSNGGSGKSQRYCFNSQRQNGAWKGALDGKTYASDGRGQLCADVTKGEPVVLVASTAMPGEL

SEQ ID NO: 43 - DNA, 1317 bp, Streptomyces  thermocyaneoviolaceus
  CDS (1)..(1317)
gctcccgccaccgtcgcccacgcctccccgcccggcaccaaggacgtcaccgccgtcctcttcgagtgggactacgcctccgtggccaaggagtgcaccagcaccctcggcccggccggctacggctacgtgcaggtctccccgcccgccgagcacatccagggctcccagtggtggacgtcgtaccagccggtgagctacaagatcgccggccggctcggcgaccgtgccgccttccgatccatggtgaacacctgccacgccgccggggtgaaggtggtcgtcgacacggtgatcaaccacatgtcggccggcagcggcaccggcaccggaggctcgtcgtacacgaagtacgactacccggggctgtactcggccccggacttcgacgactgcaccgcggagatcaccgactaccaggaccgctggaacgtccagcactgcgaactggtgggcctcgccgacctcgacaccggtgaggagtacgtgcgacagacgatcgccggctacatgaacgacctgctctccctcggcgtcgacggcttccgcatcgacgcggccaagcacatccccgccgaggacctcgcgaacatcaagtcccgcctgagcaacccgaacgcctactggaagcaggaggtcatctacggcgccggcgaagccgtccagcccggcgagtacaccggcaccggcgacgtccaggagttccgctacgcctacgacctcaagcgggtcttcacccaggagcacctcgcctacctgaagaactacggcgaggactggggctacctgagcagcacgacggccggggtcttcgtcgacaaccacgacaccgagcgcaacggctccacgctgaactacaagaacgacgccacctacaccctggccaacgtcttcatgctggcctggccctacggcgcccccgacatcaattccggctacgagtggtccgacccggacgccggcccgcccgacggcggccacgtcgacgcctgctggcagaacggctggaagtgccagcacaagtggcccgagatcgcctccatggtcgccttccgcaacgccacccgcggcgagccggtcaccgactggtgggacgacggcgcggacgccatcgccttcggccggggcagcaagggcttcgtggccatcaaccacgagtccgccaccgtccagcgcacctaccagacctccctgcccgccggcacctactgcgacgtgcagagcaacaccacggtgacggtggactccgccggacggttcaccgccgcgctcggcccggacacggcactggccctgcacaccggcaggacgagctgc

SEQ ID NO: 44 - protein, 439 aa, Streptomyces  thermocyaneoviolaceus
APATVAHASPPGTKDVTAVLFEWDYASVAKECTSTLGPAGYGYVQVSPPAEHIQGSQWWTSYQPVSYKIAGRLGDRAAFRSMVNTCHAAGVKVVVDTVINHMSAGSGTGTGGSSYTKYDYPGLYSAPDFDDCTAEITDYQDRWNVQHCELVGLADLDTGEEYVRQTIAGYMNDLLSLGVDGFRIDAAKHIPAEDLANIKSRLSNPNAYWKQEVIYGAGEAVQPGEYTGTGDVQEFRYAYDLKRVFTQEHLAYLKNYGEDWGYLSSTTAGVFVDNHDTERNGSTLNYKNDATYTLANVFMLAWPYGAPDINSGYEWSDPDAGPPDGGHVDACWQNGWKCQHKWPEIASMVAFRNATRGEPVTDWWDDGADAIAFGRGSKGFVAINHESATVQRTYQTSLPAGTYCDVQSNTTVTVDSAGRFTAALGPDTALALHTGRTSC

SEQ ID NO: 45 - DNA, 18 bp, Pachykytospora papayracea
  CDS (1)..(18)
ggtaacgcgggccccagc

SEQ ID NO: 46 - protein, 6 aa, Pachykytospora papayracea
GNAGPS

SEQ ID NO: 47 - DNA, 21 bp, Trametes cingulata
  CDS (1)..(21)
gggagtggcggtgctgggact

SEQ ID NO: 48 - protein, 7 aa, Trametes cingulata
GSGGAGT

SEQ ID NO: 49 - DNA, 33 bp, Leucopaxillus gigantus
  CDS (1)..(33)
gggggtggttcaaacccaggtggtggagggtcg

SEQ ID NO: 50 - protein, 11 aa, Leucopaxillus gigantus
GGGSNPGGGGS

SEQ ID NO: 51 - DNA, 801 bp, Trichophaea saccata
  CDS (1)..(801)
tcgccagttcatcagaacaccaaacgatctacccaagtgtcgttgatcagctatacgttttctaacaatattctctctggatccatcagcattcaaaacattgcttacgccaaaacggtcagcgttacctatgccattgggagctcttggagctcctctcaggtgataagcgctgcctactccacaggtcctgatagcaccggttatgaagtctggacgtttagcggcacagcaacgggggcaactcagttctacattgcgtatactgtctcagggaccacctactacgatcctggaaatggcatcaattacacgatcggcacgggttcgtccactacttccagcacatctgccacttcgacaaccaaaagttccaccacttccacgagcactgcgactagcacaagcgtggcgaccagcagtctccctgctatcatttcatccagtattccttctgaggcggcagccaccgcgctttctggatgcaatacttgggatggttttgacaactgccaaactagtggcgtgtacgactttgtggccagtgccgaaaaccgcagatggcagacgcccccggacggcgatcctgcctatgtcaatacgttccaagactaccgagatctcattggctacgccgatatccagtacagcccttcacgaacctccgccgttgtgactgtcaatgctgcttcgcggaccggcgagactttgacctacaaatttgggggaattactcagacgtctaacgcgtacaccgtgagcagctcgtttatcggaaccctggcaatcacagtcaccagt

SEQ ID NO: 52 - protein, 267 aa, Trichophaea saccata
SPVHQNTKRSTQVSLISYTFSNNILSGSISIQNIAYAKTVSVTYAIGSSWSSSQVISAAYSTGPDSTGYEVWTFSGTATGATQFYIAYTVSGTTYYDPGNGINYTIGTGSSTTSSTSATSTTKSSTTSTSTATSTSVATSSLPAIISSSIPSEAAATALSGCNTWDGFDNCQTSGVYDFVASAENRRWQTPPDGDPAYVNTFQDYRDLIGYADIQYSPSRTSAVVTVNAASRTGETLTYKFGGITQTSNAYTVSSSFIGTLAITVTS

SEQ ID NO: 53 - DNA, 75 bp, Subulispora provurvata
  CDS (1)..(75)
ggaggcagcggtaccactaccacgaccactaccagcactgcaggcacatcgccaacttcgacagcgtgctcctcg

SEQ ID NO: 54 - protein, 25 aa, Subulispora provurvata
GGSGTTTTTTTSTAGTSPTSTACSS

SEQ ID NO: 55 - DNA, 45 bp, Valsaria rubricosa
  CDS (1)..(45)
acgaccaccaagacgtccacctcgaccgcctcctgcgccgccacc

SEQ ID NO: 56 - protein, 15 aa, Valsaria rubricosa
TTTKTSTSTASCAAT

SEQ ID NO: 57 - DNA, 78 bp, Acremonium sp.
  CDS (1)..(78)
accagcacagcgctgccgacgtcaagcttgactgcagcatcagccacgacgactgcctcagcctgctccttgtcggcg

SEQ ID NO: 58 - protein, 26 aa, Acremonium sp.
TSTALPTSSLTAASATTTASACSLSA

SEQ ID NO: 59 - DNA, 45 bp, Meripilus giganteus
  CDS (1)..(45)
gccacgcccacctccgcccctagtactacaccaaccagcggcact

SEQ ID NO: 60 - protein, 15 aa, Meripilus giganteus
ATPTSAPSTTPTSGT

SEQ ID NO: 61 - DNA, 9 bp, Bacillus flavothermus
  CDS (1)..(9)
aacgccaca

SEQ ID NO: 62 - protein, 3 aa, Bacillus flavothermus
  PEPTIDE (1)..(3)
NAT

SEQ ID NO: 63 - DNA, 186 bp, Bacillus flavothermus
  CDS (1)..(186)
actgagaagttggcaggtagcaagatctgtagtggcagtggaaataccacaacaacgactaccgcggctactagcaccagtaaagccactacatcaagttccagctcttcggcggctgcaacaactagttcatcttgtactgctacatctactacgctgcctataacatttgaagagctcgtaacg

SEQ ID NO: 64 - protein, 62 aa, Bacillus flavothermus
TEKLAGSKICSGSGNTTTTTTAATSTSKATTSSSSSSAAATTSSSCTATSTTLPITFEELVT

SEQ ID NO: 65 - DNA, 105 bp, Bacillus flavothermus
  CDS (1)..(105)
actgagaagttggcaggtagcaagatctgtagtacatacactacggcctcaccacctccgggaggttgttctgcgggaactgtagttttcgatgtgtatgtccaa

SEQ ID NO: 66 - protein, 35 aa, Bacillus flavothermus
TEKLAGSKICSTYTTASPPPGGCSAGTVVFDVYVQ

SEQ ID NO: 67 - DNA, 33 bp, Athelia rolfsii
  CDS (1)..(33)
ggtgctacaagcccgggtggctcctcgggtagt

SEQ ID NO: 68 - protein, 11 aa, Athelia rolfsii
GATSPGGSSGS

SEQ ID NO: 69 - DNA, 93 bp, Aspergillus kawachii
  CDS (1)..(93)
acaaccacgaccacaactgctgctgctactagtacatccaaagccaccacctcctcttcttcttcttctgctgctgctactacttcttcatca

SEQ ID NO: 70 - protein, 31 aa, Aspergillus kawachii
TTTTTTAAATSTSKATTSSSSSSAAATTSSS

SEQ ID NO: 71 - DNA, 111 bp, Aspergillus niger
  CDS (1)..(111)
actggcggcaccactacgacggctacccccactggatccggcagcgtgacctcgaccagcaagaccaccgcgactgctagcaagaccagcaccagtacgtcatcaacctcc

SEQ ID NO: 72 - protein, 37 aa, Aspergillus niger
TGGTTTTATPTGSGSVTSTSKTTATASKTSTSTSSTS

SEQ ID NO: 73 - DNA, 96 bp, Coniochaeta sp.
  CDS (1)..(96)
accacgacaacagctacgacgaagacgagcacgacgctgaccacgtcgacgacaacaacctccacaaagacaagtagttcttgcaccgccaccgcg

SEQ ID NO: 74 - protein, 32 aa, Coniochaeta sp.
TTTTATTKTSTTLTTSTTTTSTKTSSSCTATA

SEQ ID NO: 75 - DNA, 285 bp, Pachykytospora papayracea
  CDS (1)..(285)
gtgaaggtgacgttcaacgtccaggctacgactaccttcggcgagaacatctacatcaccggtaacaccgctgcgctccagaactggtcgcccgataacgcgctcctcctctctgctgacaagtaccccacctggagcatcacgctcgacctccccgcgaacaccgtcgtcgagtacaaatacatccgcaagttcaacggccaggtcacctgggaatcggaccccaacaactcgatcacgacgcccgccgacggtaccttcacccagaacgacacctggcggtga

SEQ ID NO: 76 - protein, 94 aa, Pachykytospora papayracea
VKVTFNVQATTTFGENIYITGNTAALQNWSPDNALLLSADKYPTWSITLDLPANTVVEYKYIRKFNGQVTWESDPNNSITTPADGTFTQNDTWR

SEQ ID NO: 77 - DNA, 285 bp, Trametes cingulata
  CDS (1)..(285)
gtggccgtcaccttcaacgtgcaggcgaccaccgtgttcggcgagaacatttacatcacaggctcggtccccgctctccagaactggtcgcccgacaacgcgctcatcctctcagcggccaactaccccacttggagcatcaccgtgaacctgccggcgagcacgacgatcgagtacaagtacattcgcaagttcaacggcgcggtcacctgggagtccgacccgaacaactcgatcacgacgcccgcgagcggcacgttcacccagaacgacacctggcggtag

SEQ ID NO: 78 - protein, 94 aa, Trametes cingulata
VAVTFNVQATTVFGENIYITGSVPALQNWSPDNALILSAANYPTWSITVNLPASTTIEYKYIRKFNGAVTWESDPNNSITTPASGTFTQNDTWR

SEQ ID NO: 79 - DNA, 285 bp, Leucopaxillus gigantus
  CDS (1)..(285)
gtctctgttacgttcaatgttcaagctacaaccacctttggtgaaaacatttttttgaccggctcgatcaacgagttagctaactggtctcctgataatgctctcgccctctctgcggccaattatcccacctggagcagtaccgtcaacgttcccgcaagcactacgatccaatacaagtttatccgtaaattcaacggagccatcacctgggagtccgacccgaataggcagatcacaacgccgtcttcgggaagttttgtccagaatgactcgtggaagtag

SEQ ID NO: 80 - protein, 94 aa, Leucopaxillus gigantus
VSVTFNVQATTTFGENIFLTGSINELANWSPDNALALSAANYPTWSSTVNVPASTTIQYKFIRKFNGAITWESDPNRQITTPSSGSFVQNDSWK

SEQ ID NO: 81 - DNA, 306 bp, Subulispora provurvata
  CDS (1)..(306)
gtccccgtaacgttccgcgaaacggtcacaactacggtaggacagacaatcaagatatctggcgacgtctccgcccttggaaactgggatacggacgacgcggtggccctgagcgccgcgagctacacgtccagcaaccccgtgtgggacgtgaccgtcagcttcgcccccggcaccgtcatcgagtacaagtacatcaacgtggcgagcggcggcgccgtgacctgggaggccgacccgaaccacacctacacggtgccttcgtcctgcgccaccgccgtggtctccaacacctggcagacgtga

SEQ ID NO: 82 - protein, 101 aa, Subulispora provurvata
VPVTFRETVTTTVGQTIKISGDVSALGNWDTDDAVALSAASYTSSNPVWDVTVSFAPGTVIEYKYINVASGGAVTWEADPNHTYTVPSSCATAVVSNTWQT

SEQ ID NO: 83 - DNA, 303 bp, Valsaria rubricosa
  CDS (1)..(303)
gtcgccgtcaccttcaacgagctcgtcaccacgaactacggcgacaccatccgcctgacgggctccatctcccagctcagcagctggagcgcaacctccgggctggccctgagcgcgtccgcgtacacgtccagcaacccgctctggagcgtgacggtcagcctgccggccggcacgtcgttcgagtacaagttcgtccgcatcacgagcgacggcaccgtgacctgggaatcggacccgaaccgcagctacaccgtcccgacgtgcgcgagcaccgcgacgatcagcaatacctggcggtga

SEQ ID NO: 84 - protein, 100 aa, Valsaria rubricosa
VAVTFNELVTTNYGDTIRLTGSISQLSSWSATSGLALSASAYTSSNPLWSVTVSLPAGTSFEYKFVRITSDGTVTWESDPNRSYTVPTCASTATISNTWR

SEQ ID NO: 85 - DNA, 294 bp, Acremonium sp.
  CDS (1)..(294)
gtgaacatcaccttcaacgagctcgtcaccacggtgtggggggacacgatcaagctggccggcaacatatccgctctcggcagctggagcccaagcagcgccttgacactgagcgcatcgcagtattcacaaagcaatccgctctggtcggtctcaaccctgctcggtccaggaacggtgatcgagtacaagtttatcaaggtcagcgcctccgggactgtaacgtgggagtcagacccgaaccgcgtctacactgtgccctgcgcaactgcgacggtcagtagcacttggcga

SEQ ID NO: 86 - protein, 98 aa, Acremonium sp.
VNITFNELVTTVWGDTIKLAGNISALGSWSPSSALTLSASQYSQSNPLWSVSTLLGPGTVIEYKFIKVSASGTVTWESDPNRVYTVPCATATVSSTWR

SEQ ID NO: 87 - DNA, 285 bp, Meripilus giganteus
  CDS (1)..(285)
gtcagcatgaccttcgctgagcaggcgacgaccaccttcggcgagaacatcttcctcgtcggcagtatttcgcagctcgggaactggaacccagccagcgcgatcgccctgtcctctgcggcgtaccctacgtggtctgtgtctgtgaacattcccgctggaacgaccttccagtacaagttcatccgcaaggagacggacggtagcgtcgtctgggagtcggaccccaaccgccaggctaccgcgcccgcgtccggtaccaccacgctcacgtccagctggcgg

SEQ ID NO: 88 - protein, 95 aa, Meripilus giganteus
VSMTFAEQATTTFGENIFLVGSISQLGNWNPASAIALSSAAYPTWSVSVNIPAGTTFQYKFIRKETDGSVVWESDPNRQATAPASGTTTLTSSWR

SEQ ID NO: 89 - DNA, 261 bp, Bacillus flavothermus
  CDS (1)..(261)
accgtttggggacaaaatgtatacgttgtcgggaatatttcgcagctggggaactgggatccagtccacgcagttcaaatgacgccgtcttcttatccaacatggactgtaacaatccctcttcttcaagggcaaaacatacaatttaaatttatcaaaaaagattcagctggaaatgtcatttgggaagatatatcgaatcgaacatacaccgtcccaactgctgcatccggagcatatacagccagctggaacgtgccc

SEQ ID NO: 90 - protein, 87 aa, Bacillus flavothermus
TVWGQNVYVVGNISQLGNWDPVHAVQMTPSSYPTWTVTIPLLQGQNIQFKFIKKDSAGNVIWEDISNRTYTVPTAASGAYTASWNVP

SEQ ID NO: 91 - DNA, 294 bp, Athelia rolfsii
  CDS (1)..(294)
gtcgaggtcactttcgacgtttacgctaccacagtatatggccagaacatctatatcaccggtgatgtgagtgagctcggcaactggacacccgccaatggtgttgcactctcttctgctaactaccccacctggagtgccacgatcgctctccccgctgacacgacaatccagtacaagtatgtcaacattgacggcagcaccgtcatctgggaggatgctatcagcaatcgcgagatcacgacgcccgccagcggcacatacaccgaaaaagacacttgggatgaatcttag

SEQ ID NO: 92 - protein, 97 aa, Athelia rolfsii
VEVTFDVYATTVYGQNIYITGDVSELGNWTPANGVALSSANYPTWSATIALPADTTIQYKYVNIDGSTVIWEDAISNREITTPASGTYTEKDTWDES

SEQ ID NO: 93 - DNA, 327 bp, Aspergillus kawachii
  CDS (1)..(327)
tgcaccgcaacaagcaccaccctccccatcaccttcgaagaactcgtcaccactacctacggggaagaagtctacctcagcggatctatctcccagctcggagagtgggatacgagtgacgcggtgaagttgtccgcggatgattatacctcgagtaaccccgagtggtctgttactgtgtcgttgccggtggggacgaccttcgagtataagtttattaaggtcgatgagggtggaagtgtgacttgggaaagtgatccgaatagggagtatactgtgcctgaatgtgggaatgggagtggggagacggtggttgatacgtggagg

SEQ ID NO: 94 - protein, 109 aa, Aspergillus kawachii
CTATSTTLPITFEELVTTTYGEEVYLSGSISQLGEWDTSDAVKLSADDYTSSNPEWSVTVSLPVGTTFEYKFIKVDEGGSVTWESDPNREYTVPECGNGSGETVVDTWR

SEQ ID NO: 95 - DNA, 324 bp, Aspergillus niger
  CDS (1)..(324)
tgtaccactcccaccgccgtggctgtgactttcgatctgacagctaccaccacctacggcgagaacatctacctggtcggatcgatctctcagctgggtgactgggaaaccagcgacggcatagctctgagtgctgacaagtacacttccagcgacccgctctggtatgtcactgtgactctgccggctggtgagtcgtttgagtacaagtttatccgcattgagagcgatgactccgtggagtgggagagtgatcccaaccgagaatacaccgttcctcaggcgtgcggaacgtcgaccgcgacggtgactgacacctggcgg

SEQ ID NO: 96 - protein, 108 aa, Aspergillus niger [sequence omitted]

SEQ ID NO: 97 - DNA, 300 bp, Coniochaeta sp.
  CDS (1)..(300)
gtagcaatcaccttcaacgagctcgtgtcgacctcctacggcgacacagtcaagctcacgggcaacataacagccctgggcagctggaacacggccaacgccgtcagcctcagcgcatcgcagtacacatctggtagcccgctctggtcgggcaccgtgtctctgcctccgggcgtcggggtacagtacaagttcgtcagggtcggcagctcggggagcgtgacgtgggaggcggacccgaaccacacttattctgtgccgtgcgcggctgctactgtcggtgggagttggcagagctga

SEQ ID NO: 98 - protein, 99 aa, Coniochaeta sp.
VAITFNELVSTSYGDTVKLTGNITALGSWNTANAVSLSASQYTSGSPLWSGTVSLPPGVGVQYKFVRVGSSGSVTWEADPNHTYSVPCAAATVGGSWQS

SEQ ID NO: 99 - DNA, 1761 bp, Artificial
  Hybrid comprising Fungamyl vatiant CD ans A.rolfsii CBM
  CDS (1)..(1761)
gcaacgcctgcggactggcgatcgcaatccatttatttccttctcacggatcgatttgcaaggacggatgggtcgacgactgcgacttgtaatactgcggatcagaaatactgtggtggaacatggcagggcatcatcgacaagttggactatatccagggaatgggcttcacagccatctggatcacccccgttacagcccagctgccccagaccaccgcatatggagatgcctaccatggctactggcagcaggatatatactctctgaacgaaaactacggcactgcagatgacttgaaggcgctctcttcggcccttcatgagagggggatgtatcttatggtcgatgtggttgctaaccatatgggctatgatggaccgggtagctcagtcgattacagtgtgtttgttccgttcaattccgctagctacttccacccgttctgtttcattcaaaactggaatgatcagactcaggttgaggattgctggctaggagataacactgtctccttgcctgatctcgataccaccaaggatgtggtcaagaatgaatggtacgactgggtgggatcattggtatcgaactactccattgacggcctccgtatcgacacagtaaaacacgtccagaaggacttctggcccgggtacaacaaagccgcaggcgtgtactgtatcggcgaggtgctcgacggtgatccggcctacacttgtccctaccaggaagtcctggacggcgtactgaactaccccatttactatccactcctcaacgccttcaagtcaacctccggcagcatggacgacctctacaacatgatcaacaccgtcaaatccgactgtccagactcaacactcctgggcacattcgtcgagaaccacgacaacccacggttcgcttcttacaccaacgacatagccctcgccaagaacgtcgcagcattcatcatcctcaacgacggaatccccatcatctacgccggccaagaacagcactacgccggcggaaacgaccccgcgaaccgcgaagcaacctggctctcgggctacccgaccgacagcgagctgtacaagttaattgcctccgcgaacgcaatccggaactatgccattagcaaagatacaggattcgtgacctacaagaactggcccatctacaaagacgacacaacgatcgccatgcgcaagggcacagatgggtcgcagatcgtgactatcttgtccaacaagggtgcttcgggtgattcgtataccctctccttgagtggtgcgggttacacagccggccagcaattgacggaggtcattggctgcacgaccgtgacggttgattcgtcgggagatgtgcctgttcctatggcgggtgggctacctagggtattgtatccgactgagaagttggcaggtagcaagatctgtagtagctcgggtgctacaagcccgggtggctcctcgggtagtgtcgaggtcactttcgacgtttacgctaccacagtatatggccagaacatctatatcaccggtgatgtgagtgagctcggcaactggacacccgccaatggtgttgcactctcttctgctaactaccccacctggagtgccacgatcgctctccccgctgacacgacaatccagtacaagtatgtcaacattgacggcagcaccgtcatctgggaggatgctatcagcaatcgcgagatcacgacgcccgccagcggcacatacaccgaaaaagacacttgggatgaatcttag

SEQ ID NO: 100 - protein, 586 aa, Artificial
  Synthetic Construct
ATPADWRSQSIYFLLTDRFARTDGSTTATCNTADQKYCGGTWQGIIDKLDYIQGMGFTAIWITPVTAQLPQTTAYGDAYHGYWQQDIYSLNENYGTADDLKALSSALHERGMYLMVDVVANHMGYDGPGSSVDYSVFVPFNSASYFHPFCFIQNWNDQTQVEDCWLGDNTVSLPDLDTTKDVVKNEWYDWVGSLVSNYSIDGLRIDTVKHVQKDFWPGYNKAAGVYCIGEVLDGDPAYTCPYQEVLDGVLNYPIYYPLLNAFKSTSGSMDDLYNMINTVKSDCPDSTLLGTFVENHDNPRFASYTNDIALAKNVAAFIILNDGIPIIYAGQEQHYAGGNDPANREATWLSGYPTDSELYKLIASANAIRNYAISKDTGFVTYKNWPIYKDDTTIAMRKGTDGSQIVTILSNKGASGDSYTLSLSGAGYTAGQQLTEVIGCTTVTVDSSGDVPVPMAGGLPRVLYPTEKLAGSKICSSSGATSPGGSSGSVEVTFDVYATTVYGQNIYITGDVSELGNWTPANGVALSSANYPTWSATIALPADTTIQYKYVNIDGSTVIWEDAISNREITTPASGTYTEKDTWDES

SEQ ID NO: 101 - protein, 558 aa, Artificial
  Rhizomucor pusillus amylase with linker and SBD from A. rolfsii
SPLPQQQRYGKRATSDDWKSKAIYQLLTDRFGRADDSTSNCSNLSNYCGGTYEGITKHLDYISGMGFDAIWISPIPKNSDGGYHGYWATDFYQLNSNFGDESQLKALIQAAHERDMYVMLDVVANHAGPTSNGYSGYTFGDASLYHPKCTIDYNDQTSIEQCWVADELPDIDTENSDNVAILNDIVSGWVGNYSFDGIRIDTVKHIRKDFWTGYAEAAGVFATGEVFNGDPAYVGPYQKYLPSLINYPMYYALNDVFVSKSKGFSRISEMLGSNRNAFEDTSVLTTFVDNHDNPRFLNSQSDKALFKNALTYVLLGEGIPIVYYGSEQGFSGGADPANREVLWTTNYDTSSDLYQFIKTVNSVRMKSNKAVYMDIYVGDNAYAFKHGDALVVLNNYGSGSTNQVSFSVSGKFDSGASLMDIVSNITTTVSSDGTVTFNLKDGLPAIFTSAGATSPGGSSGSVEVTFDVYATTVYGQNIYITGDVSELGNWTPANGVALSSANYPTWSATIALPADTTIQYKYVNIDGSTVIWEDAISNREITTPASGTYTEKDTWDES

SEQ ID NO: 102 - protein, 574 aa, Artificial
  Hybrid of Meripilus giganteus amylase with A.rolfsii SBD
RPTVFDAGADAHSLHARAPSGSKDVIIQMFEWNWDSVAAECTNFIGPAGYGFVQVSPPQETIQGAQWWTDYQPVSYTLTGKRGDRSQFANMITTCHAAGVGVIVDTIWNHMAGVDSGTGTAGSSFTHYNYPGIYQNQDFHHCGLEPGDDIVNYDNAVEVQTCELVNLADLATDTEYVRGRLAQYGNDLLSLGADGLRLDASKHIPVGDIANILSRLSRSVYITQEVIFGAGEPITPNQYTGNGDVQEFRYTSALKDAFLSSGISNLQDFENRGWVPGSGANVFVVNHDTERNGASLNNNSPSNTYVTATIFSLAHPYGTPTILSSYDGFTNTDAGAPNNNVGTCSTSGGANGWLCQHRWTAIAGMVGFRNNVGSAALNNWQAPQSQQIAFGRGALGFVAINNADSAWSTTFTTSLPDGSYCDVISGKASGSSCTGSSFTVSGGKLTATVPARSAIAVHTGQKGSGGGATSPGGSSGSVEVTFDVYATTVYGQNIYITGDVSELGNWTPANGVALSSANYPTWSATIALPADTTIQYKYVNIDGSTVIWEDAISNREITTPASGTYTEKDTWDES

SEQ ID NO: 103 - DNA, 7063 bp, Artificial
  Plasmid for contruction of hybrids
  misc_feature (1)..(7063)
ctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattcgttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaagagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatgggaagctcccaggccggttgataatcagaaaagccccaaaaaacaggaagattgtataagcaaatatttaaattgtaaacgttaatattttgttaaaattcgcgttaaatttttgttaaatcagctcattttttaacgaatagcccgaaatcggcaaaatcccttataaatcaaaagaatagaccgagatagggttgagtgttgttccagtttccaacaagagtccactattaaagaacgtggactccaacgtcaaagggcgaaaaagggtctatcagggcgatggcccactacgtgaaccatcaccctaatgaagttttttggggtcgaggtgccgtaaagcagtaaatcggaagggtaaacggatgcccccatttagagcttgacggggaaagccggcgaacgtggcgagaaaggaagggaagaaagcgaaaccagcgggggctagggcggtgggaagtgtaggggtcacgctgggcgtaaccaccacacccgccgcgcttaatggggcgctacagggcgcgtggggatatccactagcatgcctcagcttcctctattgatgttacacctggacaccccttttctggcatccagtttttaatcttcagtggcatgtgagattctccgaaattaattaaagcaatcacacaattctctcggataccacctcggttgaaactgacaggtggtttgttacgctaatgcaaaggagcctatatacctttggctcggctgctgtaacagggaatataaagggcagcataatttaggagtttagtgaacttgcaacatttactattttcccttcttacgtaaatatttttctttttaattctaaatcaatctttttcaattttttgtttgtattcttttcttgcttaaatctataactacaaaaaacacatacagaaattcattcaagaatagttcaaacaagaagattacaaactatcaatttcatacacaatataaacgacgggacccggggatcgaattcatgagattatcgacttcgagtctcttcctttccgtgtctctgctggggaagctggccctcgggctgtcggctgcagaatggcgcactcagtcgatttacttcctattgacggatcggttcggtaggacggacaattcgacgacagctacatgcgatacgggtgaccaaatctattgtggtggcagttggcaaggaatcatcaaccatctggattatatccagggcatgggattcacggccatctggatctcgcctatcactgaacagctgccccaggatactgctgatggtgaagcttaccatggatattggcagcagaagatatacgacgtgaactccaacttcggcactgcagatgacctcaagtccctctcagatgcgcttcatgcccgcggaatgtacctcatggtggacgtcgtccctaaccacatgggctacgccggcaacggcaacgatgtagactacagcgtcttcgaccccttcgattcctcctcctacttccacccatactgcctgatcacagattgggacaacttgaccatggtccaagattgttgggagggtgacaccatcgtatctctgccagacctaaacaccaccgaaactgccgtgagaacaatctggtatgactgggtagccgacctggtatccaattattcagtcgacggactccgcatcgacagtgtcctcgaagtcgaaccagacttcttcccgggctaccaggaagcagcaggtgtctactgcgtcggcgaagtcgacaacggcaaccctgccctcgactgcccataccagaaggtcctggacggcgtcctcaactatccgatctactggcaactcctctacgccttcgaatcctccagcggcagcatcagcaatctctacaacatgatcaaatccgtcgcaagcgactgctccgatccgacactactcggcaacttcatcgaaaaccacgacaatccccgtttcgcctcctacacctccgactactcgcaagccaaaaacgtcctcagctacatcttcctctccgacggcatccccatcgtctacgccggcgaagaacagcactactccggcggcaaggtgccctacaaccgcgaagcgacctggctttcaggctacgacacctccgcagagctgtacacctggatagccaccacgaacgcgatccgcaaactagccatctcagctgactcggcctacattacctacgcgaatgatgcattctacactgacagcaacaccatcgcaatgcgcaaaggcacctcagggagccaagtcatcaccgtcctctccaacaaaggctcctcaggaagcagctacaccctgaccctcagcggaagcggctacacatccggcacgaagctgatcgaagcgtacacatgcacatccgtgaccgtggactcgagcggcgatattcccgtgccgatggcgtcgggattaccgagagttcttctgcccgcgtccgtcgtcgatagctcttcgctctgtggcgggagcggaagaggtgctacaagcccgggtggctcctcgggtagtgtcgaggtcactttcgacgtttacgctaccacagtatatggccagaacatctatatcaccggtgatgtgagtgagctcggcaactggacacccgccaatggtgttgcactctcttctgctaactaccccacctggagtgccacgatcgctctccccgctgacacgacaatccagtacaagtatgtcaacattgacggcagcaccgtcatctgggaggatgctatcagcaatcgcgagatcacgacgcccgccagcggcacatacaccgaaaaagacacttgggatgaatcttaggcggccgcgggccgcatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcggcc

SEQ ID NO: 104 - DNA, 41 bp, Artificial
  Primer
  misc_feature (1)..(41)
gctggggaagctggccctcgggagccctttgccccaacagc

SEQ ID NO: 105 - DNA, 42 bp, ja126r
  misc_feature (1)..(42)
agccacccgggcttgtagcaccagcagaggtgaagatagccg

SEQ ID NO: 106 - DNA, 42 bp, Artificial
  Primer
gctggggaagctggccctcgggcgccctactgtctttgacgc

SEQ ID NO: 107 - DNA, 42 bp, Artificial
  Primer
agccacccgggcttgtagcaccaccaccagaacctttctgac

SEQ ID NO: 108 - DNA, 387 bp, Zea mays
  CDS (1)..(387)
gtgcgtgttcgatttgtgctgaaaaggcagtgcacgttcgggcagagcgtctgccttgtcggcgacgaccctgcgctcggcctctgggatctgtcgaacgcgtttcctttgaagtgggcggaaagccacgactggaccttagagaaagatttgccggccaacaagctgattgagttcaagttcttgctccaagattccacaggaaagttgcattggcagggtgggccaaacagaagctttcagacaggtgaaaccgccgcaaacacattggttgtgtttgaagattggggtgatgtgaagaatcagaaaatagtagaagaggggggagtggcgtctgctgggatagaacaaactgttgtttcaaatgacagcgaaagcagaaagtag

SEQ ID NO: 109 - protein, 128 aa, Zea mays
VRVRFVLKRQCTFGQSVCLVGDDPALGLWDLSNAFPLKWAESHDWTLEKDLPANKLIEFKFLLQDSTGKLHWQGGPNRSFQTGETAANTLVVFEDWGDVKNQKIVEEGGVASAGIEQTVVSNDSESRK

SEQ ID NO: 110 - DNA, 1428 bp, Thermoascus sp.
  CDS (1)..(1428)
gcgacgcctgccgaatggcgctcgcagtcaatttactttttactcaccgatcgctttgcccgcaccgacaactcgacaaccgccgaatgtgatactagtgcggtgaagtactgtggcgggacttggcagggaatcattaaccagctggactacatccaggggatgggcttcacagcaacctggatcaccccagtgaccgccaatctcgaggatgggcagcatggggaggcataccatgggtactggcagcaggatatatatgcgttgaacccgcactttggcactcaagacgacctccgagcactgtctgacgcgctgcacgaccgaggaatgtaccttatggtcgacgtggttgccaatcattttggctacgacgcccccgccgcgtcggtcgactacagcgtcttcaacccgtttaactcggcagactacttccacactccctgcgatatcacggactacgacaaccagacccaggtcgaggattgctggctgtacaccgacgccgtcagtctgccagatgtcgataccaccaacgaggaggtcaaggagatttggtacgactgggtgggtgaccttgtgtctaactactctatcgacgggcttcgcatcgacaccgctcggcacgtacagaaggacttctggcgcgactacaacgatgccgcgggcgtgtactgcgtcggcgaggtcttccagggcgatcccgattacacatgcgggtaccaggaggttatggacggggtgctgaactatcccatctactaccccctgttgcgcgctttcagctccacatctggcagtctcagcgatctagccaacatgatcgaaacggtcaagtacacctgctcagacgctaccttgctgggcaacttcatcgagaaccacgataacccacgctttgcctcgtacaccgacgacatctccctcgccaagaacgtcgccgccttcgtgatcctctccgacgggatccccataatctacgccggtcaagaacagcactactccggcgcaggagacccggcaaaccgcgaggcaacctggctatccggttacgacacaacgagcgagctgtaccagttcattgcgaagacgaaccagatccggaatcatgctatctggcagaatgagacctacctttcttacaaaaactatgctatctacaacgagaacaacgtccttgtcatgcgcaaaggattcgacgggtcgcagatcattacaatcctcacgaacgctggcgctgacgctggttcatcgactgtctcggttccgaacaccgggttcacggctggtgcggcagtcactgagatctatacctgtgaggacattacggtctcggacagcggtgaagtgtcagtgcctatggagagcggcttgccgagggttctgtatccgaaggcgaagctggaagggagcgggatttgcgacctg

SEQ ID NO: 111 - protein, 476 aa, Thermoascus sp.
ATPAEWRSQSIYFLLTDRFARTDNSTTAECDTSAVKYCGGTWQGIINQLDYIQGMGFTATWITPVTANLEDGQHGEAYHGYWQQDIYALNPHFGTQDDLRALSDALHDRGMYLMVDVVANHFGYDAPAASVDYSVFNPFNSADYFHTPCDITDYDNQTQVEDCWLYTDAVSLPDVDTTNEEVKEIWYDWVGDLVSNYSIDGLRIDTARHVQKDFWRDYNDAAGVYCVGEVFQGDPDYTCGYQEVMDGVLNYPIYYPLLRAFSSTSGSLSDLANMIETVKYTCSDATLLGNFIENHDNPRFASYTDDISLAKNVAAFVILSDGIPIIYAGQEQHYSGAGDPANREATWLSGYDTTSELYQFIAKTNQIRNHAIWQNETYLSYKNYAIYNENNVLVMRKGFDGSQIITILTNAGADAGSSTVSVPNTGFTAGAAVTEIYTCEDITVSDSGEVSVPMESGLPRVLYPKAKLEGSGICDL

SEQ ID NO: 112 - DNA, 1440 bp, Coniocheata sp.
  CDS (1)..(1440)
ctcagcgcggccggctggcgccagcagtccatttaccaggtcatgacggaccgcttcgcgccgaccgacctgtccaccaccgccgcatgcgacacctcggcccaggcgtactgcggcggcacgtaccagggcctcatctccaagctggactacatccagggcatgggcttcaccgccgtgtggatatcgcccatcgtcaagcagatggacggcaacaccgccgacgggtcctcgtaccacgggtactgggcgcaggacatctggagtctgaacccctccttcggcacggcgggcgacctgatcgcgctctccaatgcgctgcacgcccgcgggatgtacctgatgctagacgtggtgacgaaccacgtcgcctacaagggctgcggcgcctgcgtcgactacagcctcttcacgccgttcgactcggcgtcctacttccaccccttctgtctgatcgactacagcaaccagacctccatcgagcagtgctgggagggcgacaacaccgtcagcctgcccgacctgcggaccgaggactcctccgtgcgcgccatctggaacgactggattgcgcaggtcgtggagacgtacggcatcgacggcctgcgcgtcgacagcgtcaagcaccaggagacgtcgttctggtccggcttcggggccgccgccggcgtcttcatgctgggcgaggtgtacaacggcgacccggcgcagctggcgccctaccaggactacatgccgggcctgctggactacgcgagctactactggatcacgcgcgccttccagtcgagctcgggaagcatcagcaaccttgcctccggcatcaacacgctcaagggcgtcgcgaggaacaccagcctgtacgggagcttcctcgagaaccacgaccagccgcggttcgcgtcgctgactgcggatctcgcgctggccaagaacgcgatcgcgttcacgatgctgaaagacggcatcccggtcgtgtaccagggccaggagcagcacttcgccggaggaaacgtgccggccgaccgcgaggcgctctggtcgtcggggtacgacacgtccgcgacgctgtacgcgtggatcgcagcgctgaataagatccgcgcgagggccatcgcgcaggacggcgcgtacctgagctaccaggcgtatccggtgtacacggacagcaacaccatcgccatgcgcaaaggacgagacgggtaccagatcgtcggggtgttcaccaacaagggctcctcgggagggacgtcgagcgtcacgctcacgacgtcgatgacggggtttactgccggccaggccgtggtggacgtcatgagctgcacgacgttcacggcggactcaagcggcagcctgggcatcacgctctcgggggggattccaagggtgttctacccgagcgcaaggctgagcgggtccgggatatgcgggtccgggagc

SEQ ID NO: 113 - protein, 480 aa, Coniocheata sp.
LSAAGWRQQSIYQVMTDRFAPTDLSTTAACDTSAQAYCGGTYQGLISKLDYIQGMGFTAVWISPIVKQMDGNTADGSSYHGYWAQDIWSLNPSFGTAGDLIALSNALHARGMYLMLDVVTNHVAYKGCGACVDYSLFTPFDSASYFHPFCLIDYSNQTSIEQCWEGDNTVSLPDLRTEDSSVRAIWNDWIAQVVETYGIDGLRVDSVKHQETSFWSGFGAAAGVFMLGEVYNGDPAQLAPYQDYMPGLLDYASYYWITRAFQSSSGSISNLASGINTLKGVARNTSLYGSFLENHDQPRFASLTADLALAKNAIAFTMLKDGIPVVYQGQEQHFAGGNVPADREALWSSGYDTSATLYAWIAALNKIRARAIAQDGAYLSYQAYPVYTDSNTIAMRKGRDGYQIVGVFTNKGSSGGTSSVTLTTSMTGFTAGQAVVDVMSCTTFTADSSGSLGITLSGGIPRVFYPSARLSGSGICGSGS

SEQ ID NO: 114 - DNA, 1326 bp, Nectria sp.
  CDS (1)..(1326)
gctgatacggcggcgtggaagtcccgcaacatctacttcgctttgactgaccgtattgcccgctctgctgatgacggcggcggcgatgcatgcggaaacttgggtcagtattgtggtggcacctttaagggcctcgagggcaagcttgattacatcaagggaatggggttcgacgccatctggattacaccagttgttcaaaacagtcctggtggttaccacggctactgggcaacagacctctactctgtcaactccgaatatggaactgcagatgacctgaagagcctcgtagctactgctcatgacaagggcatttatatcatggccgatgtggtagcaaaccacatgggccctactgatatttcagcaaacaagccggagcctctcaaccaaggttcatcctatcatgacaactgcgacatcaactataatgaccaaaatagtatcgagacgtgccgcattgccggtctcccagatgtcaagacagaggatgagactatccgaaccctctataaagattggatcaagtggcttgttgaagagtactctttcgacggcattcgcattgacactgttaagcatgttgaaaagagcttctggcctggattcgccgaggccgcaggggtctactccatcggcgaagtcttcgacggaggcccagactacctcgctggctacgcgagcgttttgcctggtcttcttaactatgccatctattatcccatgaacaggttctatcagcaggcgggttcatcgcaagacctggctaatatggttgacgaggtctcgtccaagttccccgacccttccgctcttggtactttcctcgataatcacgacaacgcgcgttggctcaacaccaagaacgacaagactctgctcaagaacgccctggcttatgtgatcctcgcccgaggtatccccatcgtctattatggaaccgaacaggggtacgctggcggtaacgacccagccaaccgcgaagatctctggcgcagcagcttcagcactgatgcggaactttaccaagccattaagcgtctctctgctgctagatctgccgtcggtggcctagctgcggacgatcatcaacatgtccttgtgtctgacggtgtttacgcttggaagcgcgctggtggagacctcgttgttctcacaaccaacagtggtagcagtggtggtggtgagcgttgcctgcaaactggacgggctaaccaaaaatacgatgacgcattcggtgatggctcttataccgctgatggaaatgggcaggtctgcgttactatctccggcggtaaccctgtggtgctggtggcttcggga

SEQ ID NO: 115 - protein, 442 aa, Nectria sp.
ADTAAWKSRNIYFALTDRIARSADDGGGDACGNLGQYCGGTFKGLEGKLDYIKGMGFDAIWITPVVQNSPGGYHGYWATDLYSVNSEYGTADDLKSLVATAHDKGIYIMADVVANHMGPTDISANKPEPLNQGSSYHDNCDINYNDQNSIETCRIAGLPDVKTEDETIRTLYKDWIKWLVEEYSFDGIRIDTVKHVEKSFWPGFAEAAGVYSIGEVFDGGPDYLAGYASVLPGLLNYAIYYPMNRFYQQAGSSQDLANMVDEVSSKFPDPSALGTFLDNHDNARWLNTKNDKTLLKNALAYVILARGIPIVYYGTEQGYAGGNDPANREDLWRSSFSTDAELYQAIKRLSAARSAVGGLAADDHQHVLVSDGVYAWKRAGGDLVVLTTNSGSSGGGERCLQTGRANQKYDDAFGDGSYTADGNGQVCVTISGGNPVVLVASG

SEQ ID NO: 116 - DNA, 1323 bp, Fusarium sp.
  CDS (1)..(1323)
gcggacgcaaacgcttggaagtcgcgaaacatctatttcgcacttactgatcgtgttgcgcgaagcgctgacgataatggcggtagtgcatgcggaaacctcggaaattattgtggtggaactttcaagggtctcgagtcgaagcttgattatatcaagggcatgggatttgatgctatctggattactcccgttgttgacaatactgatggaggataccacggatactgggccaaggatctttatgcggtcaaccccaagtatggtactgcagatgacttgaagagtcttgtcaagtctgctcatgacaagaacatgtacgtcatgtgcgacgtggtcgcaaaccacatgggcaaaggaatctcagaccacaaaccctcgcccctcaacgaacaaagctcataccacactccttgcgacatcgactacagcaaccagaacagcattgaacagtgcgaaatcgccggtcttccagatctcaacaccggcagcgacactgtcaagaaggtcctctacgactggatcaaatggctcgtctctgagtacagcttcgacggtatccgcatcgacactgtcaagcatgttgaaaagcccttctggcctggtttccaagacgccgctggtgtttacgccatcggtgaagtctgggacggaggtcctgattatctcgctggttatgcccaggtcatgcctggtcttttgaactacgctatgtactaccccatgaaccgcttttaccagcaaaagggagatccttcagatgttgtcgccatgcacgatgagattagcaacaaattccctgatcccactatcctcggaacattcatcgacaaccacgataaccctcgttggctcagccagaagaatgacaaagctcttctgaagaacgccctcgcatacgttatccttgctcgaggaattcccatcgtctactacggaacagagcaaggttacgctggcggcaatgaccccgccaaccgggaagatctctggcgaagcagtttcagcaccaacgcagatctctaccaacacatctcgcgtctctctaaggctcggtcggcagtcggtggcctcggtggaaatgaccacaagcatctttactctcagaacagcgcctacgcctggagtcgtgcggacggcgatcttatcgtgcttacgttgaaccgcggtcagggatactcaggacagtactgcttcaacactggaaagaacaacaagacttgggacaaggtatttggaagtggcactgttacctctgatggcaatggacaggtttgcgttagctacactaacggtgagcctgaggtcttggttgcctctagc

SEQ ID NO: 117 - protein, 441 aa, Fusarium sp.
ADANAWKSRNIYFALTDRVARSADDNGGSACGNLGNYCGGTFKGLESKLDYIKGMGFDAIWITPVVDNTDGGYHGYWAKDLYAVNPKYGTADDLKSLVKSAHDKNMYVMCDVVANHMGKGISDHKPSPLNEQSSYHTPCDIDYSNQNSIEQCEIAGLPDLNTGSDTVKKVLYDWIKWLVSEYSFDGIRIDTVKHVEKPFWPGFQDAAGVYAIGEVWDGGPDYLAGYAQVMPGLLNYAMYYPMNRFYQQKGDPSDVVAMHDEISNKFPDPTILGTFIDNHDNPRWLSQKNDKALLKNALAYVILARGIPIVYYGTEQGYAGGNDPANREDLWRSSFSTNADLYQHISRLSKARSAVGGLGGNDHKHLYSQNSAYAWSRADGDLIVLTLNRGQGYSGQYCFNTGKNNKTWDKVFGSGTVTSDGNGQVCVSYTNGEPEVLVASS

SEQ ID NO: 118 - DNA, 1371 bp, Trametes currogata
  CDS (1)..(1371)
gcggatacgagtgcatggaagtcccgcagcatctacttcgttctgaccgatcgtgttgctcgaagcagcagcgacaccggcggttcctcttgcagcaacctgggcaattactgtggaggaactttcaaaggtctcgaatctaagctggattacatccaaggcttgggctttgacgctatctggatcacgcctgtcgttgctaacagtgctggtggctaccatggctattgggcacaagacttgtattctgtcaactcgaattatggtactgcagacgacctaaagagcctggtcagctctgctcatgcgaagggcatatatgtgatggtcgatgtcgtagccaatcatatgggtaacggtgcaattgccgataaccgccctgagcctttgaaccaggcttcatcctaccacccagcctgcgacatcaactacgataaccagaccagcatcgagcagtgcagcatcggcggtcttgctgatcttaacactgagagtaccgaggttcgcactgttctcaacacctgggtttcatggctcgtcgacgagtacagcttcgacggagtacgtatcgacacagtcaagcacgttcaaaaggacttctggccagacttcgtgtcttccataggcgaatacagcatcggtgaggtgtttgacggcaaccctccatacctcgctgagtatgccaagctcatgcctggggttctaaactatgcagtctactaccccatgaatgccttctaccagcaaacgggctcatctcaggcactggtcgacatgatgaacacgattagcagcacattcccagacccctcagcactcggcacgttcctcgacaaccacgacaacccgcgctggctaaacgtgaagaacgaccagacactcctgaagaacgcactagcctacgtcattctagcccgaggcattcccatcctatactacggcaccgagcaaggttactccggaggcgccgacccagcaaaccgcgaagatctttggcgcagcagcttcaatacaaacgcggacctctaccaatccatcaaaaagctcaccgcagcccgaaaagccgccggcggcctcgccggcaacgaccacacgcatctctacgtcgccgacacggcatatgcctggagccgggcaaacggcgccctcatcgtgctcaccaccaacgccggcagcagctccaacgcgcaacactgcttcaacacgcagatggcaaacgggaaatggacgaacacgtatggtgatggcgcaacggtgaccgcggattccagcggtaatatctgcgtcaccgttagcaacggcgagcctgttgtcctcgtcgccagcgcatcaacaacgggggttacgcccactacagctacaacgctgcgc

SEQ ID NO: 119 - protein, 457 aa, Trametes currogata
ADTSAWKSRSIYFVLTDRVARSSSDTGGSSCSNLGNYCGGTFKGLESKLDYIQGLGFDAIWITPVVANSAGGYHGYWAQDLYSVNSNYGTADDLKSLVSSAHAKGIYVMVDVVANHMGNGAIADNRPEPLNQASSYHPACDINYDNQTSIEQCSIGGLADLNTESTEVRTVLNTWVSWLVDEYSFDGVRIDTVKHVQKDFWPDFVSSIGEYSIGEVFDGNPPYLAEYAKLMPGVLNYAVYYPMNAFYQQTGSSQALVDMMNTISSTFPDPSALGTFLDNHDNPRWLNVKNDQTLLKNALAYVILARGIPILYYGTEQGYSGGADPANREDLWRSSFNTNADLYQSIKKLTAARKAAGGLAGNDHTHLYVADTAYAWSRANGALIVLTTNAGSSSNAQHCFNTQMANGKWTNTYGDGATVTADSSGNICVTVSNGEPVVLVASASTTGVTPTTATTLR

SEQ ID NO: 120 - DNA, 1428 bp, Penicillium sp.
  CDS (1)..(1428)
gcagaatggcgcagtcagtcgatctactttcttctaactgatcgctttggccgaacggacaattccaccacggcagcatgcaatgtcagcgatcgggtctactgtggtggcagctggcaaggaatcatcaatcacttggattacattcagggcatgggattcaccgcgatttggattacccctgtcacagaacagctctctcaagacactggagatggcgaggcataccacggatactggcaacaagagatatacaacgtcaacacaaactatggcactgctgctgaccttttggcactttctaaagccctgcacagtcgtggcatgtacctcatggtagacgtggttgcaaaccacatgggctatgatggagctggaaatactgttgactacagtgtctttaatccattcgactcttcgtcttacttccactcgtattgtgagatcagcgattactctgatcagacaaacgtggaggactgttggcttggagacactacagtttctcttccagatctcgacacgacccttacttctgttcagacgatctggtataactgggtcactgaattggtgtccaactactccattgatggtttgcgaattgatacagtcaaacacgtgcagaagtcgttctggccgggctacaacagtgctgcaggtgtctactgtgtgggagaggtgtttgatggggacccagcatacacttgcccctaccagagctacctcgatggtgttctgaactatccgatttattaccaactgctgtacgcattcgagtcgacaagtggcagtatcagcggtctatataatatgatcaactccgttgcatctgactgttccgatccaaccttgctcggaaacttcatcgagaatcatgacaacccacgctttgcttcctacacgagcgattattctcaagcgaagaatgtgatttctttcatcttcttctcggatggtattccaatcgtctatgctggccaggaacaacactatagcggtggcagtgaccctgccaatcgtgaagcaacttggctatccggatacgacaagacagctcagctttacacctacatcaccaccacaaacaagatccgtgccctagccatttcaaaggacagcgcctacataagttccaagaataatgctttctacactgatagcaatactattgccatgaagaaaggatctagcggctcgcaagttataactgttctttcaaaccgtggctcatcgggtagctcgtataccttgactcttagcggaagcggttactcgtctggcacgaagctcatggagatgtacacctgcacagccgtgactgtggactctagtggcaacatcgccgtgccgatggcttccggactccctcgagtctacatgcttgcttcctcggcttgctctatttgcagttctgcctgttcagca

SEQ ID NO: 121 - protein, 476 aa, Penicillium sp.
AEWRSQSIYFLLTDRFGRTDNSTTAACNVSDRVYCGGSWQGIINHLDYIQGMGFTAIWITPVTEQLSQDTGDGEAYHGYWQQEIYNVNTNYGTAADLLALSKALHSRGMYLMVDVVANHMGYDGAGNTVDYSVFNPFDSSSYFHSYCEISDYSDQTNVEDCWLGDTTVSLPDLDTTLTSVQTIWYNWVTELVSNYSIDGLRIDTVKHVQKSFWPGYNSAAGVYCVGEVFDGDPAYTCPYQSYLDGVLNYPIYYQLLYAFESTSGSISGLYNMINSVASDCSDPTLLGNFIENHDNPRFASYTSDYSQAKNVISFIFFSDGIPIVYAGQEQHYSGGSDPANREATWLSGYDKTAQLYTYITTTNKIRALAISKDSAYISSKNNAFYTDSNTIAMKKGSSGSQVITVLSNRGSSGSSYTLTLSGSGYSSGTKLMEMYTCTAVTVDSSGNIAVPMASGLPRVYMLASSACSICSSACSA

SEQ ID NO: 122 - DNA, 1353 bp, Valsaria spartii
  CDS (1)..(1353)
gccagcaacgcggattggaaatcgcgcaacatctactttgccttgacggaccgcgtcgctggtcctaccgggggatcatgcggcaacctgggaaactactgcggcggtacctggaacggattgacggataagttggactacatccagggcatgggattcgatgccatctggatcaccccggtcatcaagaacagccccggcggttatcacggatattgggctcaagatctctacagcgtgaacgagaactatggcactgcgcaagatctgaaggatttcgtaaatgcggcgcacgcaaaggggatctacgtcatggtcgacgtggtcgcaaaccacatgggcaacggtggaatctcaactctctccccacctcccttgaaccaggagagttcctatcactccaaatgcaacatcgactacagcagccaaaacagcatcgagaattgctggatcgctgacctgcccgacctcgtcaccaccgacaacaccatccgcgatgtcttcaaggactggatcgccaacctcaccaccacctactccttcgacggcctccgcgtcgacaccgtcaagcatgtagagaaggacttttggccgggcttcgtcgaggctgccggcatgtatgccatcggcgaggttctcgatggcggcacctcctacgttgccggctaccagagcgtgatgccaggccttctcaactatcccatgtactatcctctcatccgcacctttacccagggcgcctccttcaacgacttcgtcaacagtcacaacgaggttggttccggattctccgatcccaccctcctcggcaccttcatcgacaaccacgaccagcagcgcttcctctacaagaacagcgaccacgccctcttgaagaacgctctggcctacgtgatccttggccgaggtatcccaatcgtgtactacggcaccgagcaagcctacggcggtggtgacgacccggcgaaccgcgaggacctctggcgaagcggctactccaccacctccgagatatacaccaccatctcgggcctatcctccgctcgcaaatccgccggcggcctcccaggcaacgaccactcccacctctacaccaccaacaacgcgtacgcctggtcccgcgcggacgggaaggtgatcgcgttggtgaccaacgccggcggctccgacaccagcacccactgcttcaacaccaagaaaccgagcggcacgcgctggaccagcgtcctccgcagcggcggaaccagctacaccgccgacggcaacggccaaatctgcatccagatccaaaacggcgggcccgaggcaatcgtcctctccaccggcaccggcaccgaaaccacatccagcgcc

SEQ ID NO: 123 - protein, 451 aa, Valsaria spartii
ASNADWKSRNIYFALTDRVAGPTGGSCGNLGNYCGGTWNGLTDKLDYIQGMGFDAIWITPVIKNSPGGYHGYWAQDLYSVNENYGTAQDLKDFVNAAHAKGIYVMVDVVANHMGNGGISTLSPPPLNQESSYHSKCNIDYSSQNSIENCWIADLPDLVTTDNTIRDVFKDWIANLTTTYSFDGLRVDTVKHVEKDFWPGFVEAAGMYAIGEVLDGGTSYVAGYQSVMPGLLNYPMYYPLIRTFTQGASFNDFVNSHNEVGSGFSDPTLLGTFIDNHDQQRFLYKNSDHALLKNALAYVILGRGIPIVYYGTEQAYGGGDDPANREDLWRSGYSTTSEIYTTISGLSSARKSAGGLPGNDHSHLYTTNNAYAWSRADGKVIALVTNAGGSDTSTHCFNTKKPSGTRWTSVLRSGGTSYTADGNGQICIQIQNGGPEAIVLSTGTGTETTSSA

SEQ ID NO: 124 - DNA, 1431 bp, Thermoascus auranticus
  CDS (1)..(1431)
gccacgccagcccaatggcgctctcgatcagtatacttccttctgacggacaggtttgcaaggagtgatgggtcaaccaccgctgcctgtgacaccagtgcaaggcaatactgcggcggaacttggcaggggataatcgaccatctcgactatatccaaggaatgggattcactgctatttggatttcccccgtcaccgaacagctgcctcaggatacgggagatgggacagcgtatcatggctactggcagcaagatatttactccctgaatcccaactttggcacagccgacgacctccgcgcgctcgcagacgctctccatgcacgcggaatgtacctcatggtcgacgtcgtagccaaccatatgggatacgccggcccggggaactctgtcgactacagcgtcttcaaccccttcaacaaacaggaatacttccacccctactgcgagataaccaactacgacgaccaatccaacgtcgagaattgctggctcggagacacaatagtctcactgcccgatctgaatacggccaggtcggatgtagaggatatatggtacagttgggtgagggctctggtgtcgaactactcggtcgacggcctccgcatcgacaccgtcaaacacgtccagaaggacttctggcccggctacaacgacgccgcgggcgtctactgcgtgggcgaggtgttcgacggtgaccccagctacacctgcgactaccagaactatctggatggggtgctgaactatccgatgtactaccccctcctcagagcgttctcctccacgagcggcagcatcagcgacctgtacaacatgatcaacacggtgaaatcgcagtgcgcggattcgaccctcctgggtacctttgtcgagaaccatgacgtgccgaggtttgcttcatacacgagcgacatcgccctcgccaagaacgcgatcgcgttcaccatcctctcggacggcatccctattatctatgccggccaggagcagcactacagcggcggcaacgaccccgcgaaccgcgaggcggtctggctgtccggctactcgacgaccagcgagctctaccagttcatcgcggtctcgaaccagatccgcaattacgccatctatgtggacgaggggtatttgacgtacaaggcctggcccatctatcaagacagccacacgctcgcaatccgcaaaggattcgacggcaatcaggtcatcaccgtgctctcgaacctgggttcctccggcagctcgtacacgctctcgctgagcgggacgggctatgctgccggccagcaggtgaccgagatctactcctgcacggatgtcacggccgactcgaacgggaatatcgcggtctccatgggtggtgggcttccgaaggcgtttttcccgacagcaaagctggctgggagtggaatctgttggaaa

SEQ ID NO: 125 - protein, 477 aa, Thermoascus auranticus
ATPAQWRSRSVYFLLTDRFARSDGSTTAACDTSARQYCGGTWQGIIDHLDYIQGMGFTAIWISPVTEQLPQDTGDGTAYHGYWQQDIYSLNPNFGTADDLRALADALHARGMYLMVDVVANHMGYAGPGNSVDYSVFNPFNKQEYFHPYCEITNYDDQSNVENCWLGDTIVSLPDLNTARSDVEDIWYSWVRALVSNYSVDGLRIDTVKHVQKDFWPGYNDAAGVYCVGEVFDGDPSYTCDYQNYLDGVLNYPMYYPLLRAFSSTSGSISDLYNMINTVKSQCADSTLLGTFVENHDVPRFASYTSDIALAKNAIAFTILSDGIPIIYAGQEQHYSGGNDPANREAVWLSGYSTTSELYQFIAVSNQIRNYAIYVDEGYLTYKAWPIYQDSHTLAIRKGFDGNQVITVLSNLGSSGSSYTLSLSGTGYAAGQQVTEIYSCTDVTADSNGNIAVSMGGGLPKAFFPTAKLAGSGICWK

SEQ ID NO: 126 - DNA, 1347 bp, Phanerochaete chryosporium
  CDS (1)..(1347)
gcgcccgcgcaccatgccgtgcgcgcgccctcgcaggccaagaccgtcatcgcgcagatgttcgagtggacgtgggacagcgtcgccgccgagtgcaccgcgttcctcggccccgccggctacggcttcgtgcaggtcagccccgcgcaggagcacgtccagggcccgcagtggtggacggactaccagcccgtgtcgtacaccctcacctccaagcgcggcacgcgcgcgcagcaccagaacatggtcaatacgtgccaagccgccggcgtgggagtcattgcggacacgatcttcaatcacatgagcggccaggacaatggcggcgtcggcgtcgcggggtcgtccttccagcactatgtataccccggcatctaccagaaccaggacttccaccactgcggcctcgagcccggcgacgacatcgtgaactacgacaatgccgtcgaggtgcagacctgcgagctcgtgaacctcgccgaccttgctacagagaccgagtatgttcgcagccggctcgcagagtacgccaacgatttgctgtcgttgggcgtcgacgggctgcggctcgacgcagcgaagcacatcaatgcgaatgacattgccaacatcacgtctcgcttcacgcggaagccctacctaacacaggaggtcatctacggggccggggagcccatcacgcccaatcaatacgtcttcattggtgatgtgcaagacgccttctctggcggcgggatctcgagcctgcagaacctcgacaaccaaggctgggtcccgggcacctctgcgaacgtcttcgtcacgatccacgacacggagaggaacggagcctcgctgaacgcaaactcgccatcgaacacatacacgctcgcgatggtcttctcgctcgcacacccgtacggcacgccgacgatcctctcgagctacagcggcttcacggacacggacgccggtgcacccaacggcggcacaggcacctgcacggccggcggcggcgcggacggctggctgtgccagcaccgctggacggccgtcgcgggcatggtcggcttccggaacaccgtcggcggcgcgccgctcacgaactgggccgcgccgagcgctgagcaaattgcgttcgggcgcggcgcgctcgggttcgtcgcgctcaacaacgcggacgcggtgtggagcgcggcgttcagcacggcgctccccgacggcacgtactgcgatgtcgtcggcggcgcgagccagggtgggaagtgcacgggcagcgcgtttacggtcaagggcggggcgttcaccgcgaacgtacaggcgcgcaacgcgattgcgatacacgtcggcgcgaagggcaccgcgggc

SEQ ID NO: 127 - protein, 449 aa, Phanerochaete chryosporium
APAHHAVRAPSQAKTVIAQMFEWTWDSVAAECTAFLGPAGYGFVQVSPAQEHVQGPQWWTDYQPVSYTLTSKRGTRAQHQNMVNTCQAAGVGVIADTIFNHMSGQDNGGVGVAGSSFQHYVYPGIYQNQDFHHCGLEPGDDIVNYDNAVEVQTCELVNLADLATETEYVRSRLAEYANDLLSLGVDGLRLDAAKHINANDIANITSRFTRKPYLTQEVIYGAGEPITPNQYVFIGDVQDAFSGGGISSLQNLDNQGWVPGTSANVFVTIHDTERNGASLNANSPSNTYTLAMVFSLAHPYGTPTILSSYSGFTDTDAGAPNGGTGTCTAGGGADGWLCQHRWTAVAGMVGFRNTVGGAPLTNWAAPSAEQIAFGRGALGFVALNNADAVWSAAFSTALPDGTYCDVVGGASQGGKCTGSAFTVKGGAFTANVQARNAIAIHVGAKGTAG

SEQ ID NO: 128 - DNA, 1308 bp, Rhizopus oryzae
  CDS (1)..(1308)
gcctcagccagcgactgggagaaccgagtcatctaccaattgttaactgatcgatttgcaaaatcgaccgatgataccaatggctgcaataacctgagtgactactgtggcggaacatttcaaggaatcattaatcacttggattacattgccggaatgggatttgatgctatctggatatcacctatccccaaaaatgcgaatggaggttaccatggctattgggctactgacttttctcaaataaatgagcattttggaactgctgatgacttgaaaaagttggttgcagctgctcatgcaaagaacatgtacgttatgctggacgttgttgccaatcatgctggcattccttcatcaggtggcgactactctggctacacgttcggtcaaagctctgaataccacacagcctgtgatatcaattacaacagccagacctctattgagcagtgctggatttctggtttgcctgatatcaacactgaagactcggccattgttagcaaattgaattcgattgtttctggttgggtatctgattatggctttgacggtcttcgaatcgacactgtgaagcacattcgtaaagatttctgggacggctatgtctctgctgctggtgtatttgctaccggagaagtgcttagcggcgatgtttcttatgtctcaccctatcagcagcatgttccttctttactcaactacccattgtattatccagtctatgatgtattcaccaaatcccgtaccatgagccgtttaagctctggcttttctgatattaaaaatggaaactttaaagacattgatgtcttggtcaactttattgacaatcacgatcagcctcgtttgttatccaaagctgatcaaagtctcgtcaagaatgctcttgcttattctttcatggtccaaggtatccctgtcttgtactatggtacagaacaatccttcaagggtggtaacgatcctaacaacagagaggtcttatggaccactggttactcgaccacatctgatatgtacaagtttgtcactactcttgtcaaggcacgcaagggctcaaactccacagtaaatatgggaattgctcaaaccgataacgtctatgtgttccaaagaggtggctctctggttgttgtcaataactatggtcaaggatcaacaaacacaattactgtaaaggctggctcgttctctaatggagatactttgactgatgtgttctccaacaaatctgttactgttcaaaataaccagatcacattccaattgcagaatggaaaccctgccatattccaaaagaaa

SEQ ID NO: 129 - protein, 436 aa, Rhizopus oryzae
ASASDWENRVIYQLLTDRFAKSTDDTNGCNNLSDYCGGTFQGIINHLDYIAGMGFDAIWISPIPKNANGGYHGYWATDFSQINEHFGTADDLKKLVAAAHAKNMYVMLDVVANHAGIPSSGGDYSGYTFGQSSEYHTACDINYNSQTSIEQCWISGLPDINTEDSAIVSKLNSIVSGWVSDYGFDGLRIDTVKHIRKDFWDGYVSAAGVFATGEVLSGDVSYVSPYQQHVPSLLNYPLYYPVYDVFTKSRTMSRLSSGFSDIKNGNFKDIDVLVNFIDNHDQPRLLSKADQSLVKNALAYSFMVQGIPVLYYGTEQSFKGGNDPNNREVLWTTGYSTTSDMYKFVTTLVKARKGSNSTVNMGIAQTDNVYVFQRGGSLVVVNNYGQGSTNTITVKAGSFSNGDTLTDVFSNKSVTVQNNQITFQLQNGNPAIFQKK

SEQ ID NO: 130 - DNA, 1338 bp, Thaminidium elegans
  CDS (1)..(1338)
aacggtgtcacgactttgagcaagcgtgcagctgctgatgactggaaatcccggtccatttaccaagttgtgacggatcgtttcggtcgctcggatggctcgacctctgcttgcggtgacctgtccaactactgcggcggtgactacaagggcattcagaatcagctcgactacattgctggcatgggcttcgacgccatttggatctcgcctattcctgagaacacagacggcggctaccatggttactgggcaaaggactttgaaaagctcaacaccaattttggcagtgcggatgatctcaaggctctcgtgacagctgcgcacggcaagggcatgtatgtcatgctggatgtcgtcacaaaccacgcaggtcccgccagcggcgactacagcggcttcaccttcagctccgccagtaattatcatccgcagtgcacgatcgactgcgacaaccagacttccgtcgagcagtgctgggtggcggacaacctgcccgacattaacaccgaggatgataccattgtttccaagctgcacagcattgtctctgattgggtcaccacctacgattttgatggcattcgtatcgatactgtcaagcatatccgtaaagacttctggtctggctacgaagaggctgctggagtctttgctactggcgaagtctttgacggcgacgcggcttatgtcggtccttaccaggaccagttgagctcgctcatcaactacccactttactatgctatccgcgatgtcttcaccgccggctcgggctttagccgcatcagcgacatgctttccagcatcaactcgaacttcaaggacccctccgcgctcacgacctttgtggataaccaagacaacgcccgcttcctcagtgtgaagagtgacatgtctctgtacaagaatgctcttgcgttcacgattctgaccgagggtatccctgttgtgtactacggcaccgagcaaggcttcaaaggtggtgatgaccccaagaaccgtgaggtcctctggacctccaactatgatacctcctcggatctctacaagtttatcaagattgtgaacaatgatgttcgccagaaatcaaacaagtctgtgactctgaacgtagacgtgggaaccaacacctacgcgttcacacacggcaagaatctcatcgttgtcaacaactatggcagtggttccactgcgtctgtcactgtcaaggctggtgacattgcagacggcacaaaactggtggatgctgtcagtaacattacggctaccgtctcgggaggcagcatcacattctccttgaaggacggtcttccggctcttttcgtgcccagctcg

SEQ ID NO: 131 - protein, 446 aa, Thaminidium elegans
NGVTTLSKRAAADDWKSRSIYQVVTDRFGRSDGSTSACGDLSNYCGGDYKGIQNQLDYIAGMGFDAIWISPIPENTDGGYHGYWAKDFEKLNTNFGSADDLKALVTAAHGKGMYVMLDVVTNHAGPASGDYSGFTFSSASNYHPQCTIDCDNQTSVEQCWVADNLPDINTEDDTIVSKLHSIVSDWVTTYDFDGIRIDTVKHIRKDFWSGYEEAAGVFATGEVFDGDAAYVGPYQDQLSSLINYPLYYAIRDVFTAGSGFSRISDMLSSINSNFKDPSALTTFVDNQDNARFLSVKSDMSLYKNALAFTILTEGIPVVYYGTEQGFKGGDDPKNREVLWTSNYDTSSDLYKFIKIVNNDVRQKSNKSVTLNVDVGTNTYAFTHGKNLIVVNNYGSGSTASVTVKAGDIADGTKLVDAVSNITATVSGGSITFSLKDGLPALFVPSS

SEQ ID NO: 132 - DNA, 1305 bp, Absidia crista
  CDS (1)..(1305)
gcaggcgccgatgattggagatcacgttccatctatcaattattgactgatcgctttgctggtggcggtgattgttctgatttatccgattattgtggtggtaattataaaggcatgattgaacacctggattatatccaaggaatgggattcgatgccatctggatttcccccatccctaccaactcacccggcggttaccatggctactgggcaactgacttcaatggtttaaatgaaaactttggaaccaaggacgatctcaaggctttggtggatgcagcacataagctcgacatgtatgtcatgttggatgtcgttgccaatcatgctggacaacccagtacggcaggtgactattctggctacacattcgattctaaagaccaataccattcccaatgcaaaatcgattatgatgatcaaaactctattgagcagtgttgggtggctgatgtgttgcctgacatcaacactgaggatgataacgtggtcaagacgctcaatgatattgtcagcaactgggtaactacatatggctttgatggtattcgcattgacactgtcaagcatgtacgtcaagacttttgggatggatacaatgaagcagctggtgtatttgctacaggagaagtctttgatggtgattcatcctatgttggtggatatcaaaagcatttggactcgcttctcaattacccaatgtattacgcactcaatgatgtatttggttctggaaagggttttagtcgtatcagcgagatgattgcaaccaatgcagatgcatttgctgataccagtgttctgaccaactttattgacaaccatgataacccacgtttccttaataccaacaaggatactactctcttcaagaacgctttgacctacgtgttgctcgctgatggtattccagtggtgtattatggatcagaacaaggcttttcaggtggtgctgatcctgccaatcgtgaagcattatggtcaactgactttgacacctcgtccgatttgtacaagtttatggctactgtcaacaaggatgttcgtcaaaaggaaaacaaaaaggtggtgatggatgttgatgtgcaagacaacgtgtatgcattcatgcacggcgatgctcttgtggtattgaacaactacggcagtggagccagcaacgaggttactgtcaaggtcggatcacatgttgatgatggagccaagatgaacgacgtctttaccaatagcacagtctcggtatctggtggttcattcactttcaaacttgacaatggaaatcctgccatctttaccactgct

SEQ ID NO: 133 - protein, 435 aa, Absidia crista
AGADDWRSRSIYQLLTDRFAGGGDCSDLSDYCGGNYKGMIEHLDYIQGMGFDAIWISPIPTNSPGGYHGYWATDFNGLNENFGTKDDLKALVDAAHKLDMYVMLDVVANHAGQPSTAGDYSGYTFDSKDQYHSQCKIDYDDQNSIEQCWVADVLPDINTEDDNVVKTLNDIVSNWVTTYGFDGIRIDTVKHVRQDFWDGYNEAAGVFATGEVFDGDSSYVGGYQKHLDSLLNYPMYYALNDVFGSGKGFSRISEMIATNADAFADTSVLTNFIDNHDNPRFLNTNKDTTLFKNALTYVLLADGIPVVYYGSEQGFSGGADPANREALWSTDFDTSSDLYKFMATVNKDVRQKENKKVVMDVDVQDNVYAFMHGDALVVLNNYGSGASNEVTVKVGSHVDDGAKMNDVFTNSTVSVSGGSFTFKLDNGNPAIFTTA

SEQ ID NO: 134 - DNA, 1308 bp, Syncephalastrum racemosum
  CDS (1)..(1308)
gcgactgctagtgactgggaaaatcgagttatctaccaattgttgacagatcgatttgctaaaagctctgacgacacaaacggttgctccaacctaggcaattattgtggcgggacgtttcaagggattatcaatcatctagactatattgccggtatgggattcgatgcgatctggatatcgccaattcctgaaaactcggatggggggtatcacggttactgggctaccaacttttctgccatcaactcacattttgggtcgtctaatgatttgaagaaattggtgtcagcagctcatgacaagggcatgtatgttatgcttgacgtggttgctaaccacgttggcataccttcctccagtggccaatactcgggatacacgtttgatcaaagctctcagtatcatagttcttgtgatattaactatgacaaccaaaactctattgaacaatgctggatctctggcttacctgatcttaacaccgaagattcagcggtagtcagcaagctaaactcgattgtgtcaaactgggtatccgaatatgactttgatgggcttcgtattgatactgtcaagcacattcgcaaggatttttgggatggctatgtatctgctgcaggtgtatttgccactggggaagtcttgaacggtgctgtttcttatgttgctccataccaacaacatgttccctctttactcaactacccactgtatttccccgtcaatgatgtgttcacgaaggcttctaccatgagtcgtttgggatcaggctatgctgatatccagtctggcagctttacaaacagaaaccatctggttaactttatcgacaaccatgacaatcctcgtttgttatccaagtctgatcaggtcttggtgaagaatgctcttacatacaccatgatgattgaaggaatcccagccatgtactatggtaccgagcaatcattcaatggaggctctgaccctgccaacagagaggtcttatggaccacgaattattcgaccacatccgacatgtacaagtttgtcactttactcgtcaaaacacgcaagagctcgggaaacacggttactacaggcattgaccagaccaacaatgtttatgtgtttcaaagagacaagtatctggttgttgtgaacaattacggctcaggatccaccaattcgatcactgtaaaggctggttcattctccaatggtgttacccttgtggatatattctcgaataaaacagtgactgtgtcaaacggatcgatcaccttccagcttcaaaatggtaatcctgctgtattccaaagcaaa

SEQ ID NO: 135 - protein, 436 aa, Syncephalastrum racemosum
ATASDWENRVIYQLLTDRFAKSSDDTNGCSNLGNYCGGTFQGIINHLDYIAGMGFDAIWISPIPENSDGGYHGYWATNFSAINSHFGSSNDLKKLVSAAHDKGMYVMLDVVANHVGIPSSSGQYSGYTFDQSSQYHSSCDINYDNQNSIEQCWISGLPDLNTEDSAVVSKLNSIVSNWVSEYDFDGLRIDTVKHIRKDFWDGYVSAAGVFATGEVLNGAVSYVAPYQQHVPSLLNYPLYFPVNDVFTKASTMSRLGSGYADIQSGSFTNRNHLVNFIDNHDNPRLLSKSDQVLVKNALTYTMMIEGIPAMYYGTEQSFNGGSDPANREVLWTTNYSTTSDMYKFVTLLVKTRKSSGNTVTTGIDQTNNVYVFQRDKYLVVVNNYGSGSTNSITVKAGSFSNGVTLVDIFSNKTVTVSNGSITFQLQNGNPAVFQSK

SEQ ID NO: 136 - DNA, 297 bp, Coniochaeta sp.
  CDS (1)..(297)
gtagccatcacgttcaacgagctcgtgtccacagcctacggcgatacgatcaagctctccggcaacataaccgccctaggcagctggaacgcggccaacgccgtcagcctgagcgcgtcggggtacacggccgccaacccgctgtggtcgggcacggtgaacctcgcgccggggaccggggtgcagtacaagttcgtgaaggtcggcagctcgggaagcgtcacctgggaggcggacccgaatcacacgtacgccgtgccgtgcgcgggggctactgttagtgggagctggcagagc

SEQ ID NO: 137 - protein, 99 aa, Coniochaeta sp.
VAITFNELVSTAYGDTIKLSGNITALGSWNAANAVSLSASGYTAANPLWSGTVNLAPGTGVQYKFVKVGSSGSVTWEADPNHTYAVPCAGATVSGSWQS

SEQ ID NO: 138 - DNA, 300 bp, Trametes corrugata
  CDS (1)..(300)
gttgcagtatcgttcacgcacagcatcaccactgtgcccggcgacactatcaagatcgcgggtaacacgacgcaactcggtagctggactgtagcttccgcacccgcgctctcagcgtcatcgtacacgtcgagtaaccctgtatggacgattacgctgagcatgccggcgaagcaggcggtgcagtataagtttgttaaggtggcgagtgggggcgcggtgacgtgggagagcgatccgaatcgtagttatagcgtcccggcgtgtcaggcgagtgcggcggtgagtagtagttggcag

SEQ ID NO: 139 - protein, 100 aa, Trametes corrugata
VAVSFTHSITTVPGDTIKIAGNTTQLGSWTVASAPALSASSYTSSNPVWTITLSMPAKQAVQYKFVKVASGGAVTWESDPNRSYSVPACQASAAVSSSWQ

SEQ ID NO: 140 - DNA, 306 bp, Valsario spartii
  CDS (1)..(306)
gtctccgtcacattcaccaacctcgtcacaacccaggtcggcgacaccatcaaagtcaccggcaacgtctcgcagctgggcaactggaacccttcctccgcccccgccttatccgcaaccggatacacggccagcaaccccaaatggagcggaaccgtcaagttgcccgccggctcgacggtgcagtataagtttgtgaaggtcgctagcgggggtggcgccgtgacttgggagagcgatcccaacaggagttatagcgttcctagttgtcaggctagcgcgactgttgattcgagctggaagtaa

SEQ ID NO: 141 - protein, 101 aa, Valsario spartii
VSVTFTNLVTTQVGDTIKVTGNVSQLGNWNPSSAPALSATGYTASNPKWSGTVKLPAGSTVQYKFVKVASGGGAVTWESDPNRSYSVPSCQASATVDSSWK

SEQ ID NO: 142 - DNA, 312 bp, Penicillium sp.
  CDS (1)..(312)
ttgccagttttgttcaaagagattgtcaccacttcatacgggcagagtatctatatctcaggctctataagtcaactcggaagctgggacacgtctagcgccgttgccctctctgctgatcagtacacatcatccagccatctgtggtatgttgtcgtgacaattccagtgggcacctcgttccagtacaagttcatcgaggagacgagcgggtctagtactattacttgggagagtgatccgaaccgctcttatacggtgccaacgggctgtgcaggctcaacggctaccgtcacagcgacctggagatag

SEQ ID NO: 143 - protein, 103 aa, Penicillium sp.
LPVLFKEIVTTSYGQSIYISGSISQLGSWDTSSAVALSADQYTSSSHLWYVVVTIPVGTSFQYKFIEETSGSSTITWESDPNRSYTVPTGCAGSTATVTATWR

SEQ ID NO: 144 - DNA, 123 bp, Coniochaeta sp.
  CDS (1)..(123)
acgacgtcgacgagtacggggacgagctcgaccacgaggacggggacgacgctgacgacgtccacgaagactacggcgtcgacgacgacgacgaagagcagcagttcctgcaccgccacagca

SEQ ID NO: 145 - protein, 41 aa, Coniochaeta sp.
TTSTSTGTSSTTRTGTTLTTSTKTTASTTTTKSSSSCTATA

SEQ ID NO: 146 - DNA, 30 bp, Trametes corrugata
  CDS (1)..(30)
actaccacagcctccgcgtgtccgacttcc

SEQ ID NO: 147 - protein, 10 aa, Trametes corrugata
TTTASACPTS

SEQ ID NO: 148 - DNA, 33 bp, Valsario spartii
  CDS (1)..(33)
accacctccccaaccgccggctgcccctccacc

SEQ ID NO: 149 - protein, 11 aa, Valsario spartii
TTSPTAGCPST

SEQ ID NO: 150 - DNA, 132 bp, Penicillium sp.
  CDS (1)..(132)
actaccacaacctcgtcgacggcttctacttcaacgacaacgtcaaccacactgaagactaccacgacaacgtcaactacttcgaaaactactacgtccactacatccacgagctgcacacaggctactgca

SEQ ID NO: 151 - protein, 44 aa, Penicillium sp.
TTTTSSTASTSTTTSTTLKTTTTTSTTSKTTTSTTSTSCTQATA

SEQ ID NO: 152-153 - skipped (2 entries)

SEQ ID NO: 154 - DNA, 1221 bp, Streptomyces limosus
  CDS (1)..(1221)
gccccgcccggggcgaaggacgtcaccgccgtcctcttcgagtggaagttcgcctccgtagcccgcgcctgcaccgacagcctcggcccggccggctacggatacgtccaggtctcgccgccccaggagcacatccagggcagccagtggtggacctcctaccagcccgtcagctacaagatcgccggacggctcggcgaccgcgccgccttcaagtccatggtcgacacctgccacgcggccggcgtcaaggtcgtcgccgactcggtcatcaaccacatggccgcgggttccggcaccggcaccggcggcagcgcgtaccagaagtacgactacccgggcatctggtccggcgccgacatggacgactgccgcagcgagatcaacgactacggcaaccgcgccaacgtccagaactgcgaactggtcggcctcgccgacctcgacaccggtgagtcgtacgtccgcgaccgcatcgccgcctacctcaacgacctgctctcgctcggtgtggacggcttccgcatcgacgccgccaagcacatgcccgccgccgacctcaccgccatcaaggccaaggtcggcaacgggagcacgtactggaagcaggaggccatccacggcgcgggcgaggccgtccagcccagcgagtacctcggcaccggcgacgtccaggagttccgctacgcccgcgacctcaagcgggtcttccagaacgagaacctcgcccacctgaagaacttcggcgaggactggggctacatggcgagcggcaagtccgccgtcttcgtcgacaaccacgacaccgagcggggcggcgacaccctcaactacaagaacggctccgcctacaccctcgccggcgtcttcatgctggcctggccctacggctccccggacgtccactccggctacgagttcaccgaccacgacgccggcccgcccaacggcggcaccgtcaacgcctgctacagcgacggctggaagtgccagcacgcctggcccgagctctcctccatggtcggcctgcgcaacaccgcctccgggcagcccgtcaccaactggtgggacaacggcggcgaccagatcgccttcggccgcggcgacaaggcgtacgtcgccatcaaccacgagggctccgcgctgaaccgcaccttccagagcggcctgcccggcggcgcctactgcgacgtccagagcggcaggtccgtcacggtcggc

SEQ ID NO: 155 - protein, 407 aa, Streptomyces limosus
APPGAKDVTAVLFEWKFASVARACTDSLGPAGYGYVQVSPPQEHIQGSQWWTSYQPVSYKIAGRLGDRAAFKSMVDTCHAAGVKVVADSVINHMAAGSGTGTGGSAYQKYDYPGIWSGADMDDCRSEINDYGNRANVQNCELVGLADLDTGESYVRDRIAAYLNDLLSLGVDGFRIDAAKHMPAADLTAIKAKVGNGSTYWKQEAIHGAGEAVQPSEYLGTGDVQEFRYARDLKRVFQNENLAHLKNFGEDWGYMASGKSAVFVDNHDTERGGDTLNYKNGSAYTLAGVFMLAWPYGSPDVHSGYEFTDHDAGPPNGGTVNACYSDGWKCQHAWPELSSMVGLRNTASGQPVTNWWDNGGDQIAFGRGDKAYVAINHEGSALNRTFQSGLPGGAYCDVQSGRSVTVG

SEQ ID NO: 156 - DNA, 1443 bp, Absidia cristata
  CDS (1)..(1443)
  sig_peptide (1)..(120)
  misc_feature (121)..(1443): Catalytic domain
atgcatccaacgcgttgggagctctcccatatggtcgacctgcaggcggccgcactagtgattatgaagctttccattcttacattatccacactcctttgtgctactgctgttcttggtcgtcccattgtgaagcgtgcaggcgccgatgattggagatcacgttccatctatcaattattgactgatcgctttgctggtggcggtgattgttctgatttatccgattattgtggtggtaattataaaggcatgattgaacacctggattatatccaaggaatgggattcgatgccatctggatttcccccatccctaccaactcacccggcggttaccatggctactgggcaactgacttcaatggtttaaatgaaaactttggaaccaaggacgatctcaaggctttggtggatgcagcacataagctcgacatgtatgtcatgttggatgtcgttgccaatcatgctggacaacccagtacggcaggtgactattctggctacacattcgattctaaagaccaataccattcccaatgcaaaatcgattatgatgatcaaaactctattgagcagtgttgggtggctgatgtgttgcctgacatcaacactgaggatgataacgtggtcaagacgctcaatgatattgtcagcaactgggtaactacatatggctttgatggtattcgcattgacactgtcaagcatgtacgtcaagacttttgggatggatacaatgaagcagctggtgtatttgctacaggagaagtctttgatggtgattcatcctatgttggtggatatcaaaagcatttggactcgcttctcaattacccaatgtattacgcactcaatgatgtatttggttctggaaagggttttagtcgtatcagcgagatgattgcaaccaatgcagatgcatttgctgataccagtgttctgaccaactttattgacaaccatgataacccacgtttccttaataccaacaaggatactactctcttcaagaacgctttgacctacgtgttgctcgctgatggtattccagtggtgtattatggatcagaacaaggcttttcaggtggtgctgatcctgccaatcgtgaagcattatggtcaactgactttgacacctcgtccgatttgtacaagtttatggctactgtcaacaaggatgttcgtcaaaaggaaaacaaaaaggtggtgatggatgttgatgtgcaagacaacgtgtatgcattcatgcacggcgatgctcttgtggtattgaacaactacggcagtggagccagcaacgaggttactgtcaaggtcggatcacatgttgatgatggagccaagatgaacgacgtctttaccaatagcacagtctcggtatctggtggttcattcactttcaaacttgacaatggaaatcctgccatctttaccactgct

SEQ ID NO: 157 - protein, 481 aa, Absidia cristata
MHPTRWELSHMVDLQAAALVIMKLSILTLSTLLCATAVLGRPIVKRAGADDWRSRSIYQLLTDRFAGGGDCSDLSDYCGGNYKGMIEHLDYIQGMGFDAIWISPIPTNSPGGYHGYWATDFNGLNENFGTKDDLKALVDAAHKLDMYVMLDVVANHAGQPSTAGDYSGYTFDSKDQYHSQCKIDYDDQNSIEQCWVADVLPDINTEDDNVVKTLNDIVSNWVTTYGFDGIRIDTVKHVRQDFWDGYNEAAGVFATGEVFDGDSSYVGGYQKHLDSLLNYPMYYALNDVFGSGKGFSRISEMIATNADAFADTSVLTNFIDNHDNPRFLNTNKDTTLFKNALTYVLLADGIPVVYYGSEQGFSGGADPANREALWSTDFDTSSDLYKFMATVNKDVRQKENKKVVMDVDVQDNVYAFMHGDALVVLNNYGSGASNEVTVKVGSHVDDGAKMNDVFTNSTVSVSGGSFTFKLDNGNPAIFTTA

SEQ ID NO: 158 - DNA, 1878 bp, Acremonium sp.
  CDS (1)..(1878)
  sig_peptide (1)..(63)
  misc_feature (64)..(1506): Catalytic domain
  misc_feature (1507)..(1584): Linker
  misc_feature (1585)..(1878): CBM
atgcgcactctccaccaagcccttcttgtcctggccggagcagtcctggaagcttcgcaaggtgctgccgggctctcggctgccgagtggcggagccagtccatctaccaggttgtcaccgacaggttcgcccggaccgacctgtcgaccacggcgtcgtgcaacacggcagaccaagtctactgcggagggacatggcaggggctcatctccaagctggactacatccagggcatgggtttcaccgccgtatggatctcaccagtggtcaagcaggtggaaggcaattcccaggacgggtcggcctatcacggatactgggcgcaggatatctgggccttgaatccggcttttgggaccgaggaggatctcgctgcgcttgccgcggcgctgcatgcccgaggcatgtacctcatggttgacattgtcaccaaccacatggcatacatgggctgcggcacctgtgtagactacagcctgttcaaccccttctcatcgtcatcgtacttccacccatattgcgccatcgactacagcaaccagacgtcggtcgaggtttgctggcaaggggataacattgtcagtctgcctgacctgcgcaccgaggatgacacggtgcgcagcatctggaaccgctgggttagccagctcgtgtccaactactccatcgacggcttccgagtcgacagcgcaaaacacgtcgagacgtccttttggcaagacttctcgacagcggcgggcgtgtacctgctgggcgaggtctttgacggggacccgtcgtacgtggcgccttaccagaactacctcaacggggttctggattatcccagctactactggatcctccgggctttccagtcatccagcggcagcatcagcgacctcgtctccgggctcaacacgctccatggcgttgctctggacctgagtctatatgggtccttcctcgagaaccacgatgtggcgcggtttgcgtccttcacgcaggacatgtccctagcgaagaatgccatcgcattcacaatgctgaaagacggcatccccatcatataccagggacaagagcaacattacgctggcggaacgacgcccaacaaccgcgaggcgctctggctctcgggctactcgactagctccgagctctacaagtggattgccgccttgaaccagatccgggcccgagctattgctcaagatagcggctacctctcctacagcagccaagccatctactcggacagccataccattgccatgcgcaaaggtacctcgggataccagatcgtgggcgtgttcaccaatgtcggggcctcgtcgtcggctacggtcaccctaacctcttccgcaacgggcttcggggcgaaccaagcactcgtcgacgtgatgagctgcaccgcttacaccacagattcgacgggagccctcacggtaaccctgaacgacggcctgcccaaggtgctttatccgattgcgcggctctcgggcagcggtatctgcccagggcagaccagcacagcgctgccgacgtcaagcttgactgcagcatcagccacgacgactgcctcagcctgctccttgtcggcggtgaacatcaccttcaacgagctcgtcaccacggtgtggggggacacgatcaagctggccggcaacatatccgctctcggcagctggagcccaagcagcgccttgacactgagcgcatcgcagtattcacaaagcaatccgctctggtcggtctcaaccctgctcggtccaggaacggtgatcgagtacaagtttatcaaggtcagcgcctccgggactgtaacgtgggagtcagacccgaaccgcgtctacactgtgccctgcgcaactgcgacggtcagtagcacttggcga

SEQ ID NO: 159 - protein, 626 aa, Acremonium sp.
MRTLHQALLVLAGAVLEASQGAAGLSAAEWRSQSIYQVVTDRFARTDLSTTASCNTADQVYCGGTWQGLISKLDYIQGMGFTAVWISPVVKQVEGNSQDGSAYHGYWAQDIWALNPAFGTEEDLAALAAALHARGMYLMVDIVTNHMAYMGCGTCVDYSLFNPFSSSSYFHPYCAIDYSNQTSVEVCWQGDNIVSLPDLRTEDDTVRSIWNRWVSQLVSNYSIDGFRVDSAKHVETSFWQDFSTAAGVYLLGEVFDGDPSYVAPYQNYLNGVLDYPSYYWILRAFQSSSGSISDLVSGLNTLHGVALDLSLYGSFLENHDVARFASFTQDMSLAKNAIAFTMLKDGIPIIYQGQEQHYAGGTTPNNREALWLSGYSTSSELYKWIAALNQIRARAIAQDSGYLSYSSQAIYSDSHTIAMRKGTSGYQIVGVFTNVGASSSATVTLTSSATGFGANQALVDVMSCTAYTTDSTGALTVTLNDGLPKVLYPIARLSGSGICPGQTSTALPTSSLTAASATTTASACSLSAVNITFNELVTTVWGDTIKLAGNISALGSWSPSSALTLSASQYSQSNPLWSVSTLLGPGTVIEYKFIKVSASGTVTWESDPNRVYTVPCATATVSSTWR

SEQ ID NO: 160 - DNA, 1890 bp, Coniochaeta sp.
  CDS (1)..(1890)
  sig_peptide (1)..(69)
  misc_feature (70)..(1497): Catalytic domain
  misc_feature (1498)..(1596): Linker
  misc_feature (1597)..(1890): CBM
atgcggcctatcctaagctgcctctttctcgcgtccgtcgtggcccaggtggcgtggggcctcagcgcagcagactggcgtgagcagtccatctaccaggtcgtgacggaccgcttcgcgcggacggacctgtccaccacggccacgtgcgacacctcggcgcaggtgtattgcggcggcacgtacaagggtctgatctccaagctggattacattcagggcatgggcttcactgccatctggatatcgcccatcgtcgagcagatggacggtaatactgccgacggctcctcgtatcacggttactgggcgcaggatatttggagtctgaacccgtcgttcggatcggctggcgacctgatcgcgctctccaacgcgctgcacgcccggggcatgtacctcatgctggacgtggtgaccaaccactttgcttacaacggctgcggcaactgcgtcgactacagcatcttcaccccgttcaactcgtcgtcgtacttccaccccttctgcttgatcgactacaacaaccagacgtcgatcgagcagtgctgggagggagacaacaccgtcagcctgccggacctgcggacggagaactccaacgtacgcgcgatatggaacgactggatcacgcagattgtggcggcgtacggcatcgacggtctgcgcatcgacagcgtcaagcaccaggagacgtcgttctggtccggtttcgggtcggccgccggcgtgttcatgctgggcgaggtgtacaacggcgatccgacgcagctggcgccgtaccaggattacatgcccggactgctggactacgcgagctactactggatcacgagggcgttccagtcgagcagcgggagtatgagcgatctggcgtctggtgtcaacacactcaagagcattgccaggaacacaagcctgtacggatctttcctggagaaccacgaccagccgcggttcgcgtcgcttacctcggacgtcgccttggcgaagaatgcgatagcgtttactatgctgaaggacggtatcccggtcgtttaccagggccaagagcagcactatgcgggcggaaatgtcccagctgaccgcgaagcgatctggttgtcggggtactccacgtctgcgacgctgtacacctggatcgccgcgctgaacaaggtccgttcgagggctatcgcgcaagacagcagctacctgagctatcaggcgtatcctgtctatacggacagcaacaccattgccatgcgcaagggacgggacggataccaggtcatcggggtgttcaccaacaagggatcgagcgggttgtccagtctcaccctcacgacgtcgatgaccggattcacggcgggccaggcggtcgtggatgtcatgagctgcaccactttcacgacggactacagcggtagcctcgctgtcaccctttcgggaggcattccgcgggtgttctatccaagcgcgaggttgagtggctcaggaatatgtggctccaatgggaccacgacaacagctacgacgaagacgagcacgacgctgaccacgtcgacgacaacaacctccacaaagacaagtagttcttgcaccgccaccgcggtagcaatcaccttcaacgagctcgtgtcgacctcctacggcgacacagtcaagctcacgggcaacataacagccctgggcagctggaacacggccaacgccgtcagcctcagcgcatcgcagtacacatctggtagcccgctctggtcgggcaccgtgtctctgcctccgggcgtcggggtacagtacaagttcgtcagggtcggcagctcggggagcgtgacgtgggaggcggacccgaaccacacttattctgtgccgtgcgcggctgctactgtcggtgggagttggcagagc

SEQ ID NO: 161 - protein, 630 aa, Coniochaeta sp.
MRPILSCLFLASVVAQVAWGLSAADWREQSIYQVVTDRFARTDLSTTATCDTSAQVYCGGTYKGLISKLDYIQGMGFTAIWISPIVEQMDGNTADGSSYHGYWAQDIWSLNPSFGSAGDLIALSNALHARGMYLMLDVVTNHFAYNGCGNCVDYSIFTPFNSSSYFHPFCLIDYNNQTSIEQCWEGDNTVSLPDLRTENSNVRAIWNDWITQIVAAYGIDGLRIDSVKHQETSFWSGFGSAAGVFMLGEVYNGDPTQLAPYQDYMPGLLDYASYYWITRAFQSSSGSMSDLASGVNTLKSIARNTSLYGSFLENHDQPRFASLTSDVALAKNAIAFTMLKDGIPVVYQGQEQHYAGGNVPADREAIWLSGYSTSATLYTWIAALNKVRSRAIAQDSSYLSYQAYPVYTDSNTIAMRKGRDGYQVIGVFTNKGSSGLSSLTLTTSMTGFTAGQAVVDVMSCTTFTTDYSGSLAVTLSGGIPRVFYPSARLSGSGICGSNGTTTTATTKTSTTLTTSTTTTSTKTSSSCTATAVAITFNELVSTSYGDTVKLTGNITALGSWNTANAVSLSASQYTSGSPLWSGTVSLPPGVGVQYKFVRVGSSGSVTWEADPNHTYSVPCAAATVGGSWQS

SEQ ID NO: 162 - DNA, 1806 bp, Meripilus giganteus
  CDS (1)..(1806)
  sig_peptide (1)..(78)
  misc_feature (79)..(1476): Catalytic domain
  misc_feature (1477)..(1521): Linker
  misc_feature (1522)..(1806): CBM
atgtcaaactgggtcaagctcgccgcactcgccgcactcgccgccctcggagtgttctgcaccgccgccgtcgacgcccgccctactgtctttgacgccggcgcggacgcacactcgctgcatgcccgggccccctccggcagcaaggatgtcatcatccagatgtttgagtggaactgggacagcgtcgctgccgagtgcactaacttcatcggccccgccgggtacggcttcgtgcaagtgagcccgccccaggagaccatccagggcgcgcagtggtggaccgactaccagccggtgtcgtacacgctcactgggaagcggggcgaccgctcccagtttgcgaacatgattactacgtgccacgccgcgggcgtcggcgtgatcgttgacaccatctggaaccacatggcgggcgtcgactccggcacgggtaccgccggctcgtccttcacgcactacaactaccccggcatctaccaaaaccaggactttcaccactgcggcctcgagccgggcgatgacatcgtcaactacgacaacgcggttgaggtccagacctgcgagcttgtcaacctcgctgacctcgccaccgacacggagtatgtgcgcggtcgccttgcccagtacggaaacgacctgctctcgctcggtgccgatggcctgcgtcttgacgcttccaaacacattcctgtgggcgacatcgcgaacatcctgtctcgcctcagtcgctctgtctacatcacccaggaagtcatctttggggccggcgagcccatcacgccgaaccagtacaccgggaacggcgacgttcaggagttccgctacacctctgcgctaaaggacgccttcttgagctcgggcatatccaacctgcaggacttcgaaaaccgtggatgggtacctggctcgggcgccaacgtgttcgtcgtcaaccatgacaccgagcggaacggcgcgtcgctgaacaacaactcgccttcgaacacctacgtcaccgcgacgatcttctcgctcgcacacccgtacggcacgcccacgatcctctcctcgtatgatggcttcacgaacaccgacgccggtgcgccgaacaacaacgtcggcacatgctcgaccagcggtggtgcgaacgggtggctctgccagcaccgctggaccgcgatcgccggcatggtcggcttccgcaacaacgtcggcagcgctgcactcaacaactggcaggccccgcagtcgcagcagattgcgttcggtcgcggcgcacttggcttcgtcgcgatcaacaacgccgactcggcctggtctacgacgttcaccacttccctccccgatggttcctactgcgatgtcatcagcggcaaggcctccggcagtagctgcaccggttcttcgttcaccgtctccggcgggaagctgaccgccacggtgccggcgcgtagcgccatcgccgtgcacaccggtcagaaaggttctggtggtgccacgcccacctccgcccctagtactacaccaaccagcggcactgtcagcatgaccttcgctgagcaggcgacgaccaccttcggcgagaacatcttcctcgtcggcagtatttcgcagctcgggaactggaacccagccagcgcgatcgccctgtcctctgcggcgtaccctacgtggtctgtgtctgtgaacattcccgctggaacgaccttccagtacaagttcatccgcaaggagacggacggtagcgtcgtctgggagtcggaccccaaccgccaggctaccgcgcccgcgtccggtaccaccacgctcacgtccagctggcgg

SEQ ID NO: 163 - protein, 602 aa, Meripilus giganteus
MSNWVKLAALAALAALGVFCTAAVDARPTVFDAGADAHSLHARAPSGSKDVIIQMFEWNWDSVAAECTNFIGPAGYGFVQVSPPQETIQGAQWWTDYQPVSYTLTGKRGDRSQFANMITTCHAAGVGVIVDTIWNHMAGVDSGTGTAGSSFTHYNYPGIYQNQDFHHCGLEPGDDIVNYDNAVEVQTCELVNLADLATDTEYVRGRLAQYGNDLLSLGADGLRLDASKHIPVGDIANILSRLSRSVYITQEVIFGAGEPITPNQYTGNGDVQEFRYTSALKDAFLSSGISNLQDFENRGWVPGSGANVFVVNHDTERNGASLNNNSPSNTYVTATIFSLAHPYGTPTILSSYDGFTNTDAGAPNNNVGTCSTSGGANGWLCQHRWTAIAGMVGFRNNVGSAALNNWQAPQSQQIAFGRGALGFVAINNADSAWSTTFTTSLPDGSYCDVISGKASGSSCTGSSFTVSGGKLTATVPARSAIAVHTGQKGSGGATPTSAPSTTPTSGTVSMTFAEQATTTFGENIFLVGSISQLGNWNPASAIALSSAAYPTWSVSVNIPAGTTFQYKFIRKETDGSVVWESDPNRQATAPASGTTTLTSSWR

SEQ ID NO: 164 - DNA, 1929 bp, Penicillium sp.
  CDS (1)..(1929)
  sig_peptide (1)..(60)
  misc_feature (61)..(1488): Catalytic domain
  misc_feature (1489)..(1617): Linker
  misc_feature (1618)..(1929): CBM
atgaaggcacttgcgttggccgcactatgcctcgcgaaggctgttgccggtctgacggctgcagaatggcgcagtcagtcgatctactttcttctaactgatcgctttggccgaacggacaattccaccacggcagcatgcaatgtcagcgatcgggtctactgtggtggcagctggcaaggaatcatcaatcacttggattacattcagggcatgggattcaccgcgatttggattacccctgtcacagaacagctctctcaagacactggagatggcgaggcataccacggatactggcaacaagagatatacaacgtcaacacaaactatggcactgctgctgaccttttggcactttctaaagccctgcacagtcgtggcatgtacctcatggtagacgtggttgcaaaccacatgggctatgatggagctggaaatactgttgactacagtgtctttaatccattcgactcttcgtcttacttccactcgtattgtgagatcagcgattactctgatcagacaaacgtggaggactgttggcttggagacactacagtttctcttccagatctcgacacgacccttacttctgttcagacgatctggtataactgggtcactgaattggtgtccaactactccattgatggtttgcgaattgatacagtcaaacacgtgcagaagtcgttctggccgggctacaacagtgctgcaggtgtctactgtgtgggagaggtgtttgatggggacccagcatacacttgcccctaccagagctacctcgatggtgttctgaactatccgatttattaccaactgctgtacgcattcgagtcgacaagtggcagtatcagcggtctatataatatgatcaactccgttgcatctgactgttccgatccaaccttgctcggaaacttcatcgagaatcatgacaacccacgctttgcttcctacacgagcgattattctcaagcgaagaatgtgatttctttcatcttcttctcggatggtattccaatcgtctatgctggccaggaacaacactatagcggtggcagtgaccctgccaatcgtgaagcaacttggctatccggatacgacaagacagctcagctttacacctacatcaccaccacaaacaagatccgtgccctagccatttcaaaggacagcgcctacataagttccaagaataatgctttctacactgatagcaatactattgccatgaagaaaggatctagcggctcgcaagttataactgttctttcaaaccgtggctcatcgggtagctcgtataccttgactcttagcggaagcggttactcgtctggcacgaagctcatggagatgtacacctgcacagccgtgactgtggactctagtggcaacatcgccgtgccgatggcttccggactccctcgagtctacatgcttgcttcctcggcttgctctatttgcagttctgcctgttcagcaactaccacaacctcgtcgacggcttctacttcaacgacaacgtcaaccacactgaagactaccacgacaacgtcaactacttcgaaaactactacgtccactacatccacgagctgcacacaggctactgcattgccagttttgttcaaagagattgtcaccacttcatacgggcagagtatctatatctcaggctctataagtcaactcggaagctgggacacgtctagcgccgttgccctctctgctgatcagtacacatcatccagccatctgtggtatgttgtcgtgacaattccagtgggcacctcgttccagtacaagttcatcgaggagacgagcgggtctagtactattacttgggagagtgatccgaaccgctcttatacggtgccaacgggctgtgcaggctcaacggctaccgtcacagcgacctggaga

SEQ ID NO: 165 - protein, 643 aa, Penicillium sp.
MKALALAALCLAKAVAGLTAAEWRSQSIYFLLTDRFGRTDNSTTAACNVSDRVYCGGSWQGIINHLDYIQGMGFTAIWITPVTEQLSQDTGDGEAYHGYWQQEIYNVNTNYGTAADLLALSKALHSRGMYLMVDVVANHMGYDGAGNTVDYSVFNPFDSSSYFHSYCEISDYSDQTNVEDCWLGDTTVSLPDLDTTLTSVQTIWYNWVTELVSNYSIDGLRIDTVKHVQKSFWPGYNSAAGVYCVGEVFDGDPAYTCPYQSYLDGVLNYPIYYQLLYAFESTSGSISGLYNMINSVASDCSDPTLLGNFIENHDNPRFASYTSDYSQAKNVISFIFFSDGIPIVYAGQEQHYSGGSDPANREATWLSGYDKTAQLYTYITTTNKIRALAISKDSAYISSKNNAFYTDSNTIAMKKGSSGSQVITVLSNRGSSGSSYTLTLSGSGYSSGTKLMEMYTCTAVTVDSSGNIAVPMASGLPRVYMLASSACSICSSACSATTTTSSTASTSTTTSTTLKTTTTTSTTSKTTTSTTSTSCTQATALPVLFKEIVTTSYGQSIYISGSISQLGSWDTSSAVALSADQYTSSSHLWYVVVTIPVGTSFQYKFIEETSGSSTITWESDPNRSYTVPTGCAGSTATVTATWR

SEQ ID NO: 166 - DNA, 1698 bp, Streptomyces limosus
  CDS (1)..(1698)
  sig_peptide (1)..(84)
  misc_feature (85)..(1503): Catalytic domain
  misc_feature (1504)..(1701): Linker+CBM
atggcccgcagactcgccaccgcgtccctagccgtgctggcggcggccgccaccgccctcaccgcgcccacacccgccgctgccgccccgcccggggcgaaggacgtcaccgccgtcctcttcgagtggaagttcgcctccgtagcccgcgcctgcaccgacagcctcggcccggccggctacggatacgtccaggtctcgccgccccaggagcacatccagggcagccagtggtggacctcctaccagcccgtcagctacaagatcgccggacggctcggcgaccgcgccgccttcaagtccatggtcgacacctgccacgcggccggcgtcaaggtcgtcgccgactcggtcatcaaccacatggccgcgggttccggcaccggcaccggcggcagcgcgtaccagaagtacgactacccgggcatctggtccggcgccgacatggacgactgccgcagcgagatcaacgactacggcaaccgcgccaacgtccagaactgcgaactggtcggcctcgccgacctcgacaccggtgagtcgtacgtccgcgaccgcatcgccgcctacctcaacgacctgctctcgctcggtgtggacggcttccgcatcgacgccgccaagcacatgcccgccgccgacctcaccgccatcaaggccaaggtcggcaacgggagcacgtactggaagcaggaggccatccacggcgcgggcgaggccgtccagcccagcgagtacctcggcaccggcgacgtccaggagttccgctacgcccgcgacctcaagcgggtcttccagaacgagaacctcgcccacctgaagaacttcggcgaggactggggctacatggcgagcggcaagtccgccgtcttcgtcgacaaccacgacaccgagcggggcggcgacaccctcaactacaagaacggctccgcctacaccctcgccggcgtcttcatgctggcctggccctacggctccccggacgtccactccggctacgagttcaccgaccacgacgccggcccgcccaacggcggcaccgtcaacgcctgctacagcgacggctggaagtgccagcacgcctggcccgagctctcctccatggtcggcctgcgcaacaccgcctccgggcagcccgtcaccaactggtgggacaacggcggcgaccagatcgccttcggccgcggcgacaaggcgtacgtcgccatcaaccacgagggctccgcgctgaaccgcaccttccagagcggcctgcccggcggcgcctactgcgacgtccagagcggcaggtccgtcacggtcggctccgacggcaccttcaccgccaccgtcgccgccggcaccgccctggccctgcacaccggggcccgtacctgctccggcggcggaaccggccccggcaccgggcagacctccgcctccttccacgtcaacgccaccaccgcctggggcgagaacatctacgtcaccggtgaccaggccgccctcggcaactgggacccggcccgcgccctcaagctcgacccggccgcctacccggtgtggaagctcgacgtgccgctggccgccggaacccccttccagtacaagtacctgcgcaaggacgccgcggggaaggccgtctgggagtccggcgccaaccgcacggcgaccgtcggcaccaccggcgccctcaccctcaacgacacctggcgcggc

SEQ ID NO: 167 - protein, 566 aa, Streptomyces limosus
MARRLATASLAVLAAAATALTAPTPAAAAPPGAKDVTAVLFEWKFASVARACTDSLGPAGYGYVQVSPPQEHIQGSQWWTSYQPVSYKIAGRLGDRAAFKSMVDTCHAAGVKVVADSVINHMAAGSGTGTGGSAYQKYDYPGIWSGADMDDCRSEINDYGNRANVQNCELVGLADLDTGESYVRDRIAAYLNDLLSLGVDGFRIDAAKHMPAADLTAIKAKVGNGSTYWKQEAIHGAGEAVQPSEYLGTGDVQEFRYARDLKRVFQNENLAHLKNFGEDWGYMASGKSAVFVDNHDTERGGDTLNYKNGSAYTLAGVFMLAWPYGSPDVHSGYEFTDHDAGPPNGGTVNACYSDGWKCQHAWPELSSMVGLRNTASGQPVTNWWDNGGDQIAFGRGDKAYVAINHEGSALNRTFQSGLPGGAYCDVQSGRSVTVGSDGTFTATVAAGTALALHTGARTCSGGGTGPGTGQTSASFHVNATTAWGENIYVTGDQAALGNWDPARALKLDPAAYPVWKLDVPLAAGTPFQYKYLRKDAAGKAVWESGANRTATVGTTGALTLNDTWRG

SEQ ID NO: 168 - DNA, 1842 bp, Subulispora provurta
  CDS (1)..(1842)
  sig_peptide (1)..(63)
  misc_feature (64)..(1461): Catalytic domain
  misc_feature (1462)..(1536): Linker
  misc_feature (1537)..(1842): CBM
atgaagacgaacgcgctgttgctgcccggcctctgggctgccactgcccaagccttgtctgccaccgaatgggggagtcagtccatctaccaggtattgacggatcgctttgcccgcactgatgggtctactaccgcctcctgtgatgtgaacaagtactgcggcggcacctggcagggcataatcgacaagctggactacatccagggcatgggtttcactgcgatctggatttcgcctatcgtcgacaacatcgacgccgatactgttgatggcacctcttatcacggttactgggcccaggacatcacctcagtgaactcggcgttcggcacggagcaggacctcatcaacctctcagcagctctgcacgacaggggcatgtatctgatggtagacgtggtaaacaaccacatgggatacaacggctgcggcgattgtgttgactacagcatatacacgccattcaaccagcagtcctactaccacccgtactgcgccactgattacagcaacctgacctccatccaggtgtgctgggagggtgacaacattgtcagtctccccgacctgaggacagaggatgacgatgtccgcaccatgtggtacgactggatcacgccgttggtaaccaagtactcgatcgatggactgcgcatggacagcgccgagcatgtcgagaagagcttctggcctggttgggtatccgcctcgggagtatacaacataggagaggttgatgagggcgaccccaccatcttcccagactggctgaactacatcgacggaaccttgaactatccagcttactactggatcactcaagctttccagtcaacttctggttctatcagcaacctggttaatggaatcaaccaaatgaagggctcaatgaaaaccagcaccctcgggtcgttccttgagaatcacgaccagccacgattcccttctctgactagtgatgcggatttggcgaagaacgctatcgcttttgctatgcttgctgatggcgtcccaatcgtctactatggtcaagagcaggcctactcgggtggtggcgtgcctaatgaccgtgagccactgtggacatcgggatacagcaccacatcggcaggttacacgttcatcacgaccatcaacaaaatccgccgcctggctctcacccaggacagtgcctacgtagcataccagacctacccgatctattcggattctcacgtcatcgccatgaagaagagcagcgtcgtctccgtctatagcaacattggctccagcggcagcacctattcgatcaccctacctgccggcacattcactgggagtgtagcgctcacagacgtggtgagctgccagacgtacacggcgagctctactggcagcctcaccttcaccttcggacaagttccctccgtcttctacccgacggcaagcctgtccggcagcgggctctgctctagctccggaggcagcggtaccactaccacgaccactaccagcactgcaggcacatcgccaacttcgacagcgtgctcctcggtccccgtaacgttccgcgaaacggtcacaactacggtaggacagacaatcaagatatctggcgacgtctccgcccttggaaactgggatacggacgacgcggtggccctgagcgccgcgagctacacgtccagcaaccccgtgtgggacgtgaccgtcagcttcgcccccggcaccgtcatcgagtacaagtacatcaacgtggcgagcggcggcgccgtgacctgggaggccgacccgaaccacacctacacggtgccttcgtcctgcgccaccgccgtggtctccaacacctggcagacgtga

SEQ ID NO: 169 - protein, 613 aa, Subulispora provurta
MKTNALLLPGLWAATAQALSATEWGSQSIYQVLTDRFARTDGSTTASCDVNKYCGGTWQGIIDKLDYIQGMGFTAIWISPIVDNIDADTVDGTSYHGYWAQDITSVNSAFGTEQDLINLSAALHDRGMYLMVDVVNNHMGYNGCGDCVDYSIYTPFNQQSYYHPYCATDYSNLTSIQVCWEGDNIVSLPDLRTEDDDVRTMWYDWITPLVTKYSIDGLRMDSAEHVEKSFWPGWVSASGVYNIGEVDEGDPTIFPDWLNYIDGTLNYPAYYWITQAFQSTSGSISNLVNGINQMKGSMKTSTLGSFLENHDQPRFPSLTSDADLAKNAIAFAMLADGVPIVYYGQEQAYSGGGVPNDREPLWTSGYSTTSAGYTFITTINKIRRLALTQDSAYVAYQTYPIYSDSHVIAMKKSSVVSVYSNIGSSGSTYSITLPAGTFTGSVALTDVVSCQTYTASSTGSLTFTFGQVPSVFYPTASLSGSGLCSSSGGSGTTTTTTTSTAGTSPTSTACSSVPVTFRETVTTTVGQTIKISGDVSALGNWDTDDAVALSAASYTSSNPVWDVTVSFAPGTVIEYKYINVASGGAVTWEADPNHTYTVPSSCATAVVSNTWQT

SEQ ID NO: 170 - DNA, 1389 bp, Syncephalastrum racemosum
  CDS (1)..(1389)
  sig_peptide (1)..(60)
  misc_feature (61)..(1389): Catalytic domain
atgaaggtctttatgaacgttctctgtggggtccttttcctgtctcttttgactgaatccaaacctattgtgaaaaaacgtgcgactgctagtgactgggaaaatcgagttatctaccaattgttgacagatcgatttgctaaaagctctgacgacacaaacggttgctccaacctaggcaattattgtggcgggacgtttcaagggattatcaatcatctagactatattgccggtatgggattcgatgcgatctggatatcgccaattcctgaaaactcggatggggggtatcacggttactgggctaccaacttttctgccatcaactcacattttgggtcgtctaatgatttgaagaaattggtgtcagcagctcatgacaagggcatgtatgttatgcttgacgtggttgctaaccacgttggcataccttcctccagtggccaatactcgggatacacgtttgatcaaagctctcagtatcatagttcttgtgatattaactatgacaaccaaaactctattgaacaatgctggatctctggcttacctgatcttaacaccgaagattcagcggtagtcagcaagctaaactcgattgtgtcaaactgggtatccgaatatgactttgatgggcttcgtattgatactgtcaagcacattcgcaaggatttttgggatggctatgtatctgctgcaggtgtatttgccactggggaagtcttgaacggtgctgtttcttatgttgctccataccaacaacatgttccctctttactcaactacccactgtatttccccgtcaatgatgtgttcacgaaggcttctaccatgagtcgtttgggatcaggctatgctgatatccagtctggcagctttacaaacagaaaccatctggttaactttatcgacaaccatgacaatcctcgtttgttatccaagtctgatcaggtcttggtgaagaatgctcttacatacaccatgatgattgaaggaatcccagccatgtactatggtaccgagcaatcattcaatggaggctctgaccctgccaacagagaggtcttatggaccacgaattattcgaccacatccgacatgtacaagtttgtcactttactcgtcaaaacacgcaagagctcgggaaacacggttactacaggcattgaccagaccaacaatgtttatgtgtttcaaagagacaagtatctggttgttgtgaacaattacggctcaggatccaccaattcgatcactgtaaaggctggttcattctccaatggtgttacccttgtggatatattctcgaataaaacagtgactgtgtcaaacggatcgatcaccttccagcttcaaaatggtaatcctgctgtattccaaagcaaa

SEQ ID NO: 171 - protein, 463 aa, Syncephalastrum racemosum
MKVFMNVLCGVLFLSLLTESKPIVKKRATASDWENRVIYQLLTDRFAKSSDDTNGCSNLGNYCGGTFQGIINHLDYIAGMGFDAIWISPIPENSDGGYHGYWATNFSAINSHFGSSNDLKKLVSAAHDKGMYVMLDVVANHVGIPSSSGQYSGYTFDQSSQYHSSCDINYDNQNSIEQCWISGLPDLNTEDSAVVSKLNSIVSNWVSEYDFDGLRIDTVKHIRKDFWDGYVSAAGVFATGEVLNGAVSYVAPYQQHVPSLLNYPLYFPVNDVFTKASTMSRLGSGYADIQSGSFTNRNHLVNFIDNHDNPRLLSKSDQVLVKNALTYTMMIEGIPAMYYGTEQSFNGGSDPANREVLWTTNYSTTSDMYKFVTLLVKTRKSSGNTVTTGIDQTNNVYVFQRDKYLVVVNNYGSGSTNSITVKAGSFSNGVTLVDIFSNKTVTVSNGSITFQLQNGNPAVFQSK

SEQ ID NO: 172 - DNA, 1764 bp, Trametes corrugata
  CDS (1)..(1764)
  sig_peptide (1)..(60)
  misc_feature (61)..(1431): Catalytic domain
  misc_feature (1432)..(1473): Linker
  misc_feature (1474)..(1764): CBM
atgttgttcctttctacgctcctctcgttcttcttttacttcagctccattgtgacagcggcggatacgagtgcatggaagtcccgcagcatctacttcgttctgaccgatcgtgttgctcgaagcagcagcgacaccggcggttcctcttgcagcaacctgggcaattactgtggaggaactttcaaaggtctcgaatctaagctggattacatccaaggcttgggctttgacgctatctggatcacgcctgtcgttgctaacagtgctggtggctaccatggctattgggcacaagacttgtattctgtcaactcgaattatggtactgcagacgacctaaagagcctggtcagctctgctcatgcgaagggcatatatgtgatggtcgatgtcgtagccaatcatatgggtaacggtgcaattgccgataaccgccctgagcctttgaaccaggcttcatcctaccacccagcctgcgacatcaactacgataaccagaccagcatcgagcagtgcagcatcggcggtcttgctgatcttaacactgagagtaccgaggttcgcactgttctcaacacctgggtttcatggctcgtcgacgagtacagcttcgacggagtacgtatcgacacagtcaagcacgttcaaaaggacttctggccagacttcgtgtcttccataggcgaatacagcatcggtgaggtgtttgacggcaaccctccatacctcgctgagtatgccaagctcatgcctggggttctaaactatgcagtctactaccccatgaatgccttctaccagcaaacgggctcatctcaggcactggtcgacatgatgaacacgattagcagcacattcccagacccctcagcactcggcacgttcctcgacaaccacgacaacccgcgctggctaaacgtgaagaacgaccagacactcctgaagaacgcactagcctacgtcattctagcccgaggcattcccatcctatactacggcaccgagcaaggttactccggaggcgccgacccagcaaaccgcgaagatctttggcgcagcagcttcaatacaaacgcggacctctaccaatccatcaaaaagctcaccgcagcccgaaaagccgccggcggcctcgccggcaacgaccacacgcatctctacgtcgccgacacggcatatgcctggagccgggcaaacggcgccctcatcgtgctcaccaccaacgccggcagcagctccaacgcgcaacactgcttcaacacgcagatggcaaacgggaaatggacgaacacgtatggtgatggcgcaacggtgaccgcggattccagcggtaatatctgcgtcaccgttagcaacggcgagcctgttgtcctcgtcgccagcgcatcaacaacgggggttacgcccactacagctacaacgctgcgcactaccacagcctccgcgtgtccgacttccgttgcagtatcgttcacgcacagcatcaccactgtgcccggcgacactatcaagatcgcgggtaacacgacgcaactcggtagctggactgtagcttccgcacccgcgctctcagcgtcatcgtacacgtcgagtaaccctgtatggacgattacgctgagcatgccggcgaagcaggcggtgcagtataagtttgttaaggtggcgagtgggggcgcggtgacgtgggagagcgatccgaatcgtagttatagcgtcccggcgtgtcaggcgagtgcggcggtgagtagtagttggcagtga

SEQ ID NO: 173 - protein, 587 aa, Trametes corrugata
MLFLSTLLSFFFYFSSIVTAADTSAWKSRSIYFVLTDRVARSSSDTGGSSCSNLGNYCGGTFKGLESKLDYIQGLGFDAIWITPVVANSAGGYHGYWAQDLYSVNSNYGTADDLKSLVSSAHAKGIYVMVDVVANHMGNGAIADNRPEPLNQASSYHPACDINYDNQTSIEQCSIGGLADLNTESTEVRTVLNTWVSWLVDEYSFDGVRIDTVKHVQKDFWPDFVSSIGEYSIGEVFDGNPPYLAEYAKLMPGVLNYAVYYPMNAFYQQTGSSQALVDMMNTISSTFPDPSALGTFLDNHDNPRWLNVKNDQTLLKNALAYVILARGIPILYYGTEQGYSGGADPANREDLWRSSFNTNADLYQSIKKLTAARKAAGGLAGNDHTHLYVADTAYAWSRANGALIVLTTNAGSSSNAQHCFNTQMANGKWTNTYGDGATVTADSSGNICVTVSNGEPVVLVASASTTGVTPTTATTLRTTTASACPTSVAVSFTHSITTVPGDTIKIAGNTTQLGSWTVASAPALSASSYTSSNPVWTITLSMPAKQAVQYKFVKVASGGAVTWESDPNRSYSVPACQASAAVSSSWQ

SEQ ID NO: 174 - DNA, 2322 bp, Trichopheraea saccata
  CDS (1)..(2322)
  sig_peptide (1)..(60)
  misc_feature (61)..(861): Linker + CBM (N-term)
  misc_feature (862)..(2322): Catalytic domain
atgtgttcgctgcgttacttcgccctttttctgtttccatttctccttttggtcagtgcatcgccagttcatcagaacaccaaacgatctacccaagtgtcgttgatcagctatacgttttctaacaatattctctctggatccatcagcattcaaaacattgcttacgccaaaacggtcagcgttacctatgccattgggagctcttggagctcctctcaggtgataagcgctgcctactccacaggtcctgatagcaccggttatgaagtctggacgtttagcggcacagcaacgggggcaactcagttctacattgcgtatactgtctcagggaccacctactacgatcctggaaatggcatcaattacacgatcggcacgggttcgtccactacttccagcacatctgccacttcgacaaccaaaagttccaccacttccacgagcactgcgactagcacaagcgtggcgaccagcagtctccctgctatcatttcatccagtattccttctgaggcggcagccaccgcgctttctggatgcaatacttgggatggttttgacaactgccaaactagtggcgtgtacgactttgtggccagtgccgaaaaccgcagatggcagacgcccccggacggcgatcctgcctatgtcaatacgttccaagactaccgagatctcattggctacgccgatatccagtacagcccttcacgaacctccgccgttgtgactgtcaatgctgcttcgcggaccggcgagactttgacctacaaatttgggggaattactcagacgtctaacgcgtacaccgtgagcagctcgtttatcggaaccctggcaatcacagtcaccagttcatccggcaagaaattagagctggaggccctcaactttgtttggcagaatgcagttcttactggcgctcagagcactttcaacaatgggcagaagggcgctattgtggagctttttgggtggccgtatgcagatattgcaaaggagtgcgctttccttggaaaagccggatacatgggagtcaaggtttggcctccaaacgagcacatctggggatcggactactacgaaaccgacaatatgttccgtccgtggtatctggtgtaccagccggtcagttacaagcttgtgagccgtcaaggaacccgtgaggagcttcgagctatgataactgcttgccggagtgctggagtgcgcgtctatgccgacgccgtcattaatcacatgtctggaaacggaaacgatatccaaaaccatcgtaataccgcctgcgcctactggacaggccacaacgcaaccgcgaattcgccttacttcacctccggttacacctatcttattaatcccttcacgaacacacgccccaccttcgagtacccagcggtaccatggggcccaactgatttccattgcgtttcctctatcacagattggaccaacggccaaatcgtcacaaagggctatctcgtgggactctccgatctcaacacagagaaggattacgtccaggaccgcatcgccacttatcttgtggatctcttgtcaatcggcttctccggcttccgtgttgatgcggcaaaacatattggccccacctccatggcacagatcttcggaagggttgcaaagaagatgggcggaagtcttccagatgattttatcacttggcttgaagtgttgatgggtggtgagaaggagcagtatgcttgcggcggcggtgaatggagttggtacaccaacttcaatacccagctttccaatgcgggaattagtgacactgatatcaataagatcaagatttggagctccgactatcccaaggagttcccgatctgcggttcttggatcatcccatccactcgctttgtcatccaaaatgacgaccatgaccagcagaacccgggctcttcctccagagatatgggtgaccaaggctccgtactcatcaaagatcaagatgtagccaagcaccgggcatttgaggtcaagctcttcacccgtaccgacggtgactggcaaatcaggaatatcctctcctcttatatgtttgcctccaacggagcaaatggcttccccgatggtctttcggattgttccctttatactggctcacagagtgcgagtggttgtttgggtatcgcgaaggataccgcttatgtagaaggtatctgtgggtatactatggttgctggaaggtacaccaggccgcatagggatctgagcatcattaatgctatgaggagttgggtcgggttgtcgagtaccacagcggatgctcttggaatccccggttgtagctga

SEQ ID NO: 175 - protein, 773 aa, Trichopheraea saccata
MCSLRYFALFLFPFLLLVSASPVHQNTKRSTQVSLISYTFSNNILSGSISIQNIAYAKTVSVTYAIGSSWSSSQVISAAYSTGPDSTGYEVWTFSGTATGATQFYIAYTVSGTTYYDPGNGINYTIGTGSSTTSSTSATSTTKSSTTSTSTATSTSVATSSLPAIISSSIPSEAAATALSGCNTWDGFDNCQTSGVYDFVASAENRRWQTPPDGDPAYVNTFQDYRDLIGYADIQYSPSRTSAVVTVNAASRTGETLTYKFGGITQTSNAYTVSSSFIGTLAITVTSSSGKKLELEALNFVWQNAVLTGAQSTFNNGQKGAIVELFGWPYADIAKECAFLGKAGYMGVKVWPPNEHIWGSDYYETDNMFRPWYLVYQPVSYKLVSRQGTREELRAMITACRSAGVRVYADAVINHMSGNGNDIQNHRNTACAYWTGHNATANSPYFTSGYTYLINPFTNTRPTFEYPAVPWGPTDFHCVSSITDWTNGQIVTKGYLVGLSDLNTEKDYVQDRIATYLVDLLSIGFSGFRVDAAKHIGPTSMAQIFGRVAKKMGGSLPDDFITWLEVLMGGEKEQYACGGGEWSWYTNFNTQLSNAGISDTDINKIKIWSSDYPKEFPICGSWIIPSTRFVIQNDDHDQQNPGSSSRDMGDQGSVLIKDQDVAKHRAFEVKLFTRTDGDWQIRNILSSYMFASNGANGFPDGLSDCSLYTGSQSASGCLGIAKDTAYVEGICGYTMVAGRYTRPHRDLSIINAMRSWVGLSSTTADALGIPGCS

SEQ ID NO: 176 - DNA, 1761 bp, Valsaria rubricosa
  CDS (1)..(1761)
  sig_peptide (1)..(63)
  misc_feature (64)..(1413): Catalytic domain
  misc_feature (1414)..(1458): Linker
  misc_feature (1459)..(1761): CBM
atgcgatccttcctcgccctctcagccttgctgctgctgtacccgctgcagctgctcgccgccagcaactccgactggaggtcccgcaatatctactttgccttgaccgaccgcgtcgccaatccgtccaccacgaccgcatgtagtgacctgagcaactactgcggcggcacgtggagcggcctgtcgagcaagctggactacatccaagggatgggcttcgattccatctggattacccccgtggtcgagaactgcgacggtggctaccacggctactgggccaaggcgctctacaacgtcaacacgaactacggcagtgcggatgatctgaagaacttcgttgcggccgcccatgcgaagggcatgtacgtgatggtggacgtcgtcgcgaatcacatgggttcctgcggcatcgccaacctctccccacctcccctgaacgagcagagctcttatcacacccagtgcgacattgactacagcagtcagtccagcattgagacgtgctggatatccggcctccctgacctggacaccaccgatagcactatccgatccctcttccagacctgggtccacggcctggtcagcaactacagcttcgacggtctccgcgtcgacaccgtcaagcacgtggagaaggattactggcccggcttcgtgtcggcggcgggcacctacgccatcggcgaagtcttctccggcgacacctcctacgtggccggctatcaatcggtgatgccgggcttgctcaactatcccatctactatccgctcatccgcgtcttcgcgcagggtgcgtccttcaccgatctcgtcaacaaccacgataccgtcggctcgaccttctccgacccgacgctgctgggtaactttatcgacaaccacgacaacccacgtttcctgagctacaccagcgaccacgccctcctcaagaacgctctggcctacgtcatcctggccagaggcatccccatcgtctactacggcaccgagcaaggctactcgggttcgtccgacccggcgaaccgcgaggatctctggcgtagcggatacagcactacgggagacatctacaccaccatcgccgcgctctccgccgcgcgcaccgcggccggtggcctcgccggtaacgaccacgtccacctgtacacgaccgacaacgcgtacgcctggtcccgggcgagcggcaagctcatcgtcgtcacgtccaaccgcggcagctccgacagcagcaccatctgcttcagcacccagcaggccagcggcaccacctggaccagcacgatcaccggcaactcgtacaccgccgacagcaacggccagatctgcgtgcagctgtccagcggcggacccgaggcgctcgtcgtctccaccgcgaccggcaccgccaccgcgacgactctgtccacgaccaccaagacgtccacctcgaccgcctcctgcgccgccaccgtcgccgtcaccttcaacgagctcgtcaccacgaactacggcgacaccatccgcctgacgggctccatctcccagctcagcagctggagcgcaacctccgggctggccctgagcgcgtccgcgtacacgtccagcaacccgctctggagcgtgacggtcagcctgccggccggcacgtcgttcgagtacaagttcgtccgcatcacgagcgacggcaccgtgacctgggaatcggacccgaaccgcagctacaccgtcccgacgtgcgcgagcaccgcgacgatcagcaatacctggcggtga

SEQ ID NO: 177 - protein, 586 aa, Valsaria rubricosa
MRSFLALSALLLLYPLQLLAASNSDWRSRNIYFALTDRVANPSTTTACSDLSNYCGGTWSGLSSKLDYIQGMGFDSIWITPVVENCDGGYHGYWAKALYNVNTNYGSADDLKNFVAAAHAKGMYVMVDVVANHMGSCGIANLSPPPLNEQSSYHTQCDIDYSSQSSIETCWISGLPDLDTTDSTIRSLFQTWVHGLVSNYSFDGLRVDTVKHVEKDYWPGFVSAAGTYAIGEVFSGDTSYVAGYQSVMPGLLNYPIYYPLIRVFAQGASFTDLVNNHDTVGSTFSDPTLLGNFIDNHDNPRFLSYTSDHALLKNALAYVILARGIPIVYYGTEQGYSGSSDPANREDLWRSGYSTTGDIYTTIAALSAARTAAGGLAGNDHVHLYTTDNAYAWSRASGKLIVVTSNRGSSDSSTICFSTQQASGTTWTSTITGNSYTADSNGQICVQLSSGGPEALVVSTATGTATATTLSTTTKTSTSTASCAATVAVTFNELVTTNYGDTIRLTGSISQLSSWSATSGLALSASAYTSSNPLWSVTVSLPAGTSFEYKFVRITSDGTVTWESDPNRSYTVPTCASTATISNTWR

SEQ ID NO: 178 - DNA, 1749 bp, Valsaria spartii
  CDS (1)..(1749)
  sig_peptide (1)..(57)
  misc_feature (58)..(1410): Catalytic domain
  misc_feature (1411)..(1443): Linker
  misc_feature (1444)..(1749): CBM
atgcagttcctttgcgcccttgcagcactcctgtgcttcccatcgcagcttctcgccgccagcaacgcggattggaaatcgcgcaacatctactttgccttgacggaccgcgtcgctggtcctaccgggggatcatgcggcaacctgggaaactactgcggcggtacctggaacggattgacggataagttggactacatccagggcatgggattcgatgccatctggatcaccccggtcatcaagaacagccccggcggttatcacggatattgggctcaagatctctacagcgtgaacgagaactatggcactgcgcaagatctgaaggatttcgtaaatgcggcgcacgcaaaggggatctacgtcatggtcgacgtggtcgcaaaccacatgggcaacggtggaatctcaactctctccccacctcccttgaaccaggagagttcctatcactccaaatgcaacatcgactacagcagccaaaacagcatcgagaattgctggatcgctgacctgcccgacctcgtcaccaccgacaacaccatccgcgatgtcttcaaggactggatcgccaacctcaccaccacctactccttcgacggcctccgcgtcgacaccgtcaagcatgtagagaaggacttttggccgggcttcgtcgaggctgccggcatgtatgccatcggcgaggttctcgatggcggcacctcctacgttgccggctaccagagcgtgatgccaggccttctcaactatcccatgtactatcctctcatccgcacctttacccagggcgcctccttcaacgacttcgtcaacagtcacaacgaggttggttccggattctccgatcccaccctcctcggcaccttcatcgacaaccacgaccagcagcgcttcctctacaagaacagcgaccacgccctcttgaagaacgctctggcctacgtgatccttggccgaggtatcccaatcgtgtactacggcaccgagcaagcctacggcggtggtgacgacccggcgaaccgcgaggacctctggcgaagcggctactccaccacctccgagatatacaccaccatctcgggcctatcctccgctcgcaaatccgccggcggcctcccaggcaacgaccactcccacctctacaccaccaacaacgcgtacgcctggtcccgcgcggacgggaaggtgatcgcgttggtgaccaacgccggcggctccgacaccagcacccactgcttcaacaccaagaaaccgagcggcacgcgctggaccagcgtcctccgcagcggcggaaccagctacaccgccgacggcaacggccaaatctgcatccagatccaaaacggcgggcccgaggcaatcgtcctctccaccggcaccggcaccgaaaccacatccagcgccaccacctccccaaccgccggctgcccctccaccgtctccgtcacattcaccaacctcgtcacaacccaggtcggcgacaccatcaaagtcaccggcaacgtctcgcagctgggcaactggaacccttcctccgcccccgccttatccgcaaccggatacacggccagcaaccccaaatggagcggaaccgtcaagttgcccgccggctcgacggtgcagtataagtttgtgaaggtcgctagcgggggtggcgccgtgacttgggagagcgatcccaacaggagttatagcgttcctagttgtcaggctagcgcgactgttgattcgagctggaagtaa

SEQ ID NO: 179 - protein, 582 aa, Valsaria spartii
MQFLCALAALLCFPSQLLAASNADWKSRNIYFALTDRVAGPTGGSCGNLGNYCGGTWNGLTDKLDYIQGMGFDAIWITPVIKNSPGGYHGYWAQDLYSVNENYGTAQDLKDFVNAAHAKGIYVMVDVVANHMGNGGISTLSPPPLNQESSYHSKCNIDYSSQNSIENCWIADLPDLVTTDNTIRDVFKDWIANLTTTYSFDGLRVDTVKHVEKDFWPGFVEAAGMYAIGEVLDGGTSYVAGYQSVMPGLLNYPMYYPLIRTFTQGASFNDFVNSHNEVGSGFSDPTLLGTFIDNHDQQRFLYKNSDHALLKNALAYVILGRGIPIVYYGTEQAYGGGDDPANREDLWRSGYSTTSEIYTTISGLSSARKSAGGLPGNDHSHLYTTNNAYAWSRADGKVIALVTNAGGSDTSTHCFNTKKPSGTRWTSVLRSGGTSYTADGNGQICIQIQNGGPEAIVLSTGTGTETTSSATTSPTAGCPSTVSVTFTNLVTTQVGDTIKVTGNVSQLGNWNPSSAPALSATGYTASNPKWSGTVKLPAGSTVQYKFVKVASGGGAVTWESDPNRSYSVPSCQASATVDSSWK

The invention claimed is:

1. A polypeptide comprising a first amino acid sequence comprising a catalytic module having alpha-amylase activity and a second amino acid sequence comprising a carbohydrate-binding module, wherein the first amino acid sequence has at least 90% sequence identity to the amino acid sequence of SEQ ID NO: 24 and the second amino acid sequence has at least 90% sequence identity to any amino acid sequence selected from the group consisting of SEQ ID NO: 92, SEQ ID NO: 94, and SEQ ID NO: 96.

2. The polypeptide of claim 1, wherein the first amino acid sequence has at least 95% sequence identity to the amino acid sequence of SEQ ID NO: 24.

3. The polypeptide of claim 1, wherein the second amino acid sequence has at least 95% sequence identity to the amino acid sequence of SEQ ID NO: 92.

4. The polypeptide of claim 1, wherein the second amino acid sequence has at least 95% sequence identity to the amino acid sequence of SEQ ID NO: 94.

5. The polypeptide of claim 1, wherein the second amino acid sequence has at least 95% sequence identity to the amino acid sequence of SEQ ID NO: 96.

6. The polypeptide of claim 1, which further comprises a linker sequence between the first and second amino acid sequences, wherein the linker sequence has at least 95% sequence identity to any amino acid sequence selected from the group consisting of SEQ ID NO: 46, SEQ ID NO: 48, SEQ ID NO: 50, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 145, SEQ ID NO: 147, SEQ ID NO: 149, SEQ ID NO: 151, and SEQ ID NO: 52.

7. A composition comprising a polypeptide of claim 1.

8. A process for saccharifying starch, comprising treating a starch with the polypeptide of claim 1.

9. The process of claim 8, comprising converting starch into a syrup containing dextrose and/or maltose.

10. The process of claim 8, wherein the starch is gelatinized or granular starch.

11. The process of claim 8, further comprising contacting the saccharified starch with a fermenting organism to produce a fermentation product.

12. The process of claim 11, wherein the fermenting organism is a yeast and the fermentation product is ethanol.

* * * * *